US008008545B2

(12) United States Patent
Plesch et al.

(10) Patent No.: US 8,008,545 B2
(45) Date of Patent: Aug. 30, 2011

(54) PROCESS FOR THE PRODUCTION OF FINE CHEMICALS

(75) Inventors: Gunnar Plesch, Potsdam (DE); Piotr Puzio, Berlin (DE); Astrid Blau, Stahnsdorf (DE); Ralf Looser, Berlin (DE); Birgit Wendel, Berlin (DE); Beate Kamlage, Berlin (DE); Agnes Chardonnens, Berlin (DE); Amber Shirley, Wake Forest, NC (US); Xi-Qing Wang, Chapel Hill, NC (US); Rodrigo Sarria-Millan, Morrisville, NC (US); Bryan McKersie, Cary, NC (US); Ruoying Chen, Apex, NC (US)

(73) Assignee: BASF Plant Science GmbH, Ludwigshafen (DE)

( * ) Notice: Subject to any disclaimer, the term of this patent is extended or adjusted under 35 U.S.C. 154(b) by 95 days.

(21) Appl. No.: 10/566,644

(22) PCT Filed: Jul. 21, 2004

(86) PCT No.: PCT/EP2004/008136
§ 371 (c)(1),
(2), (4) Date: Feb. 22, 2006

(87) PCT Pub. No.: WO2005/014828
PCT Pub. Date: Feb. 17, 2005

(65) Prior Publication Data
US 2006/0137042 A1 Jun. 22, 2006

Related U.S. Application Data

(63) Continuation-in-part of application No. PCT/US2004/011887, filed on Apr. 15, 2004.

(51) Int. Cl.
*C12N 15/82* (2006.01)
*C12N 15/63* (2006.01)

(52) U.S. Cl. ........ 800/288; 800/281; 800/284; 435/468; 435/471; 435/440

(58) Field of Classification Search .................. 800/288, 800/281, 284; 435/468, 471, 440
See application file for complete search history.

(56) References Cited

U.S. PATENT DOCUMENTS

| | | | |
|---|---|---|---|
| 4,886,878 A | 12/1989 | Larkins et al. | |
| 5,082,993 A | 1/1992 | Strissel et al. | |
| 5,589,616 A | 12/1996 | Hoffman | |
| 5,670,635 A | 9/1997 | Datta et al. | |
| 5,792,921 A | 8/1998 | Londesborough et al. | ... 800/284 |
| 6,018,106 A | 1/2000 | Hunt et al. | ... 800/301 |
| 2004/0111763 A1 | 6/2004 | Heinz et al. | |

FOREIGN PATENT DOCUMENTS

| | | |
|---|---|---|
| EP | 0 271 408 | 6/1988 |
| WO | WO-89/11789 | 12/1989 |
| WO | WO-93/19190 | 9/1993 |
| WO | WO-95/15392 | 6/1995 |
| WO | WO-96/38574 | 12/1996 |
| WO | WO-97/07665 | 3/1997 |
| WO | WO-97/28247 | 8/1997 |
| WO | WO-01/00804 | 1/2001 |
| WO | WO-01/44276 | 6/2001 |
| WO | WO-01/59128 | 8/2001 |
| WO | WO-03/040293 | 5/2003 |

OTHER PUBLICATIONS

Madaule P. et al. Characterization of two members of the rho gene family from the yeast *Saccharomyces cerevisiae*. Proc Natl Acad Sci U S A. Feb. 1987;84(3):779-8.*
Qadota H. et al. RHO gene products, putative small GTP-binding proteins, are important for activation of the CAL1/CDC43 gene product, a protein geranylgeranyltransferase in *Saccharomyces cerevisiae*. Yeast. Sep. 1992;8(9):735-41.*
Monaghan E. et al. Mutations in the Lcb2p subunit of serine palmitoyltransferase eliminate the requirement for the TSC3 gene in *Saccharomyces cerevisiae*. Yeast. Jun. 15, 2002;19(8):659-70.*
Sano H. et al. Expression of the gene for a small GTP binding protein in transgenic tobacco elevates endogenous cytokinin levels, abnormally induces salicylic acid in response to wounding, and increases resistance to tobacco mosaic virus infection Proc Natl Acad Sci U S A. Oct. 25, 1994;91(22):10556-60.*
Parker W.B. et al. Dominant mutations causing alterations in acetyl-coenzyme A carboxylase confer tolerance to cyclohexanedione and aryloxyphenoxypropionate herbicides in maize. Proc Natl Acad Sci USA Sep. 1990;87(18):7175-9.*
Polashock J.J. et al. Expression of the Yeast Delta-9 Fatty Acid Desaturase in *Nicotiana tabacum*. Plant Physiol. Oct. 1992;100(2):894-901.
Hamill J.D. et al. Over-expressing a yeast ornithine decarboxylase gene in transgenic roots of *Nicotiana rustica* can lead to enhanced nicotine accumulation. Plant Mol Biol. Jul. 1990;15(1):27-38.
Colau D. et al. Complementation of a threonine dehydratase-deficient *Nicotiana plumbaginifolia* mutant after *Agrobacterium tumefaciens*-mediated transfer of the *Saccharomyces cerevisiae* ILV1 gene. Mol Cell Biol. Jul. 1987;7(7):2552-7.
Von Schaewen A. et al. Expression of a yeast-derived invertase in the cell wall of tobacco and *Arabidopsis* plants leads to accumulation of carbohydrate and inhibition of photosynthesis and strongly influences growth and phenotype of transgenic tobacco plants. EMBO J. Oct. 1990;9(10):3033-44.

(Continued)

*Primary Examiner* — Cynthia Collins
(74) *Attorney, Agent, or Firm* — Connolly Bove Lodge & Hutz, LLP

(57) ABSTRACT

The present invention relates to a process for the production of fine chemicals in a microorganism, a plant cell, a plant, a plant tissue or parts thereof by increasing or generating the biological activity of a ras-Like GTPase or the homologues thereof and growing the organism under conditions which permit the production of the fine chemicals in the organism. Preferred fine chemicals produced by the present invention include amino acids, carbohydrates, vitamins, fatty acids, and carotenoids.

11 Claims, 3 Drawing Sheets

OTHER PUBLICATIONS

Valster A.H. et al. Plant GTPases: the Rhos in bloom.Trends Cell Biol. Apr. 2000;10(4):141-6. Review.*

Zheng Z.L. et al. The Rop GTPase: an emerging signaling switch in plants. Plant Mol Biol. Sep. 2000;44(1):1-9.*

Eggersdorfer M. et al., "Vitamins," in Ullmann's Encyclopedia of Industrial Chemistry, second edition, 1996, vol. A27, pp. 443-613, VCH Weinheim, ASM Press.

Ong, A. S. H. et al., "Nutritional Implications of Dietary Oils and Fats in Developing Countries," in Nutrition, Lipids, Health, and Disease, Proceedings of the UNESCO/Confederation of Scientific and Technological Associations in Malaysia, and the Society for Free Radical Research—Asia Workshop held Sep. 1-3, 1994 at Penang, Malaysia, Ong A. S. H. et al. eds., 1995, Chapter 35, pp. 306-316, AOCS Press.

Leuchtenberger, W. "Amino Acids—Technical Production and Use," in Biotechnology, Rehm. et al. eds., 1996, vol. 6, Chapter 14a, pp. 466-502, VCH Weinheim.

Kleemann A. et al., "Amino Acids," in Ullmann's Encyclopedia of Industrial Chemistry, 1985, vol. A2, pp. 57-97, VCH Weinheim.

Umbarger, H. E., "Amino Acid Biosynthesis and its Regulation," Ann. Rev. Biochem, 1978, vol. 47, pp. 533-606.

Zeh, M. et al., "Antisense Inhibition of Threonine Synthase Leads to High Methionine Content in Transgenic Potato Plants," Plant Physiology, 2001, vol. 127, pp. 792-802.

Madaule, P. et al., "Characterization of Two Members of the *rho* Gene Family From the Yeast *Saccharomyces cerevisiae*," Proc. Natl. Acad. Sci., 1987, vol. 84, pp. 779-783.

Madaule P. et al., "Yeast (*S. cerevisiae*) ras-related RHO2 gene, complete cds." GenBank Accession No. M15190, Apr. 27, 1993.

Garcia-Cantalejo, J. M. et al., "*S. cerevisiae* chromosome XIV reading frame ORF YNL090W," GenBank Accession No. Z71366 & Y13139, Apr. 29, 1996.

Kuninaka, A. "Nucleotides and Related Compounds", Biotechnology, 1996, vol. 6, pp. 561-612.

* cited by examiner

Figure 1: Protein alignment of Rho small GTPases from *Oryza sativa* cv. Noppon-Brarre (a japonica rice), *Brassica napus* cv. "AC Excel" "Quantum" and "Cresor" (canola), and *Glycine max* cv. Resuick (soybean). Boxes (doted line) represent the identical amino acid.

```
BN41992996   (1) -----------------------MSASRFIKCYTVGDGAVGKTCLLISYTSNTFPTDYVPTMFDNFSAN--VVVNGATVNLGLWDTAGQEDYNRLRFL
BN42135991   (1) -----------------------MSASRFIKCYTVGDGAVGKTCMLISYTSNTFPTDYVPTMFDNFSAN--VVVDGNTVNLGLWDTAGQEDYNRLRFL
BN42385898   (1) -----------------------MSASRFIKCYTVGDGAVGKTCLLISYTSNTFPTDYVPTMFDNFSAN--VVVNGATVNLGLWDTAGQEDYNRLRFL
BN42519337   (1) -----------------------MSTARFIKCYTVGDGAVGKTCMLISYTSNTFPTDYVPTMFDNFSAN--VVVDGSTVNLGLWDTAGQEDYNRLRFL
BN42557868   (1) ----------MSASVAAASVSTTTTAATTFIKCYTVGDGAVGKTCLLISYTSNTFPTDYVPTMFDNFSAN--VLVDGKTVNLGLWDTAGQEDYNRLRFL
BN43381801   (1) ----------------------MASTASKFIKCYTVGDGAVGKTCMLICYTSNKFPTDYIPTVFDNFSAN--VVVEGTTVNLGLWDTAGQEDYNRLRFL
BN44062474   (1) ----------------------MASSASKFIKCYTVGDGAVGKTCMLICYTSNTFPTDYVPTMFDNFSAN--VVVEGTTVNLGLWDTAGQEDYNRLRFL
BN44504217   (1) -----------------------MSASRFIKCYTVGDGAVGKTCMLICYTSNTFPTDYVPTMFDNFSAN--VVVDGNTVNLGLWDTAGQEDYNRLRFL
BN45412825   (1) -----------------------MSASRFIKCYTVGDGAVGKTCLLISYTSNTFPTDYVPTMFDNFSAN--VIVDGNTINLGLWDTAGQEDYNRLRFL
GM47124407   (1) -----------------------MSTARFIKCYTVGDGAVGKTCMLISYTSNTFPTDYVPTMFDNFSAN--VTVDGSTVNLGLWDTAGQEDYNRLRFL
GM47172047   (1) -----------------------MSTTRFIKCYTVGDGAVGKTCMLISYTSNTFPTDYVPTMFDNFSAN--VVVDGSTVNLGLWDTAGQEDYNRLRFL
GM48914268   (1) -----------------------MSASRFIKCYTVGDGAVGKTCLLISYTSNTFPTDYVPTMFDNFSAN--VVVDGSTVNLGLWDTAGQEDYNRLRFL
GM49741326   (1) ----------------------MASATAPRFIKCYTVGDGAVGKTCMLICYTSNKFPTDYIPTVFDNFSAN--VVVEGITVNLGLWDTAGQEDYNRLRFL
GM50199916   (1) -----------------------MSASRFIKCYTVGDGAVGKTCMLISYTSNTFPTDYVPTMFDNFSAN--VVVDGSTVNLGLWDTAGQEDYNRLRFL
GM50693528   (1) -----------------------MSASRFIKCYTVGDGAVGKTCLLISYTSNTFPTDYVPTMFDNFSAN--VVVNGSTVNLGLWDTAGQEDYNRLRFL
GM52260563   (1) -----------------------MSASRFIKCYTVGDGAVGKTCMLISYTSNTFPTDYVPTMFDNFSAN--VVVDGSTVNLGLWDTAGQEDYNRLRFL
OS30848846   (1) -----------------------MSGATKFIKCYTVGDGAVGKTCMLICYISNKFPTDYIPTMFDNFSAN--VSVDGNIVNLGLWDTAGQEDYSRLRFL
OS32558796   (1) MGCSSSVPARSTGGLNNISNDNSATDSKDLRAKLVLLGDSGVGKSCIVLRFVRGQFDPTSKVTVGASFLSQTLALEDSTIVKFEIWDTAGQERYAALAFL
OS33960403   (1) ------------------------MASSASRFIKCYTVGDGAVGKTCMLICYTSNKFPTDYVPTMFDNFSAN--VVVDGTTVNLGLWDTAGQEDYNRLRLL
OS35505384   (1) -----------------MGSKPPPPPQPSVSELLLLGDGRVGKTSLVLRYVNDVSDKQEATVQASYLTKR-LVVEGVPITLSIWDTAGQEKFHALGFI
OS37807380   (1) ----------------------MSSAAAATRFIKCYTVGDGAVGKTCMLICYTCNKFPTDYIPTVFDNFSAN--VSVDGSVVNLGLWDTAGQEDYSRLRFL
YNL090W      (1) ----------------------MSEKAVRRKIVIIGDAGGKTSLLYVFTLGKFPEQYHPTVFENYVTD--CRVDGIKVSLTLWDTAGQEEYERLRPF
```

```
BN41992996   (74)  SYRGADVFILAFSLISKASYENVSKKWIPELTHYAPGVPIVLVGTKLDLRDD-KQFFVDHPGAVPITTAQGEELMKLIGAPSYIECSSKSQENVKGVFDA
BN42135991   (74)  SYRGADVFILAFSLISKASYENIAKKWIPELRHYAPGVPIILVGTKLDLRDD-KQFFIDHPGAVPITTNQGEELKKLIGSPVYIECSSKTQQNVKAVFDA
BN42385898   (74)  SYRGADVFILAFSLISKASYENVSKKWIPELTHYAPGVPIVLVGTKLDLRDD-KQFFVDHPGAVPITTAQGEELMKLIGAPSYIECSSKSQENVKGVFDA
BN42519337   (74)  SYRGADVFLLAFSLISKASYENIYKKWLPELKHYAPSIPIVLVGTKLDLRDD-KQFLKDHPGAASITTAQGEELRKMIGAIKYLECSSKTQQNVKAVFDT
BN42557868   (88)  SYRGADVFILAFSLISRPSFENIAKKWVPELRHYAPNVPIVLVGTKLDLRED-KKFPMNYPGACTISTEQGQELRKEIGALAYIECSSKTQQNVKAVFDA
BN43381801   (76)  SYRGADVFVLSFSLVSRASYENVYKKWIPELQHFAPGVPLVLVGTKLDLREDNKHYLADHPGLSPVTTAQGEELRKLIGATYYIECSSKTQQNVKAVFDS
BN44062474   (76)  SYRGADVFVLSFSLVSRASYENVFKKWIPELQHFAPGVPLVLVGTKLDLRED-KHYLADHPGLSPVTTAQGEELRKLIGATYYIECSSKTQQNVKAVFDS
BN44504217   (74)  SYRGADVFILAFSLISKASYENIAKKWIPELRHYAPGVPIILVGTKLDLRDD-KQFFIDHPGAVPISTNQGEELKKLIGSPAYIECSSKTQQNVKAVFDA
BN45412825   (74)  SYRGADVFLLAFSLVSKASYENVSKKWVPELRHYAPGVPIILVGTKLDLRDD-KQFFVEHPGAVPISTAQGEELKKVIGAPAYIECSAKTQQNVKAVFDA
GM47124407   (74)  SYRGADVFLLCYSLISKASYENISKKWIPELRHYAPNVPIVLVGTKLDLRDD-KQFLIDHPGSARITTAQGEELKKMIGAVTYIECSSKTQLNVKTVFDA
GM47172047   (74)  SYRGADVFLLAFSLVSKASYENISKKWIPELRHYAPTVPIVLVGTKLDLRED-RQYLIDHPGTTAIATAQGEELKKAIGAAVYIECSSKTQQNVKAVFDA
GM48914268   (74)  SYRGADVFILAFSLISKASYENIAKKWIPELRHYAPGVPIILVGTKLDLRDD-KQFFMDHPGAVPITTAQGEELRKLIGAPAYIECSSKTQQNVKAVFDA
GM49741326   (77)  SYRGADVFVLAFSLVSRASYENVLKKWIPELQHFAPGIPLVLVGTKLDLRED-KHYMADHPSLVPVTTDQGEELRKHIGATYYIECSSKTQQNVKAVFDA
GM50199916   (74)  SYRGADVFLLAFSLISRASYENVAKKWIPELRHYAPGVPIILVGTKLDLRDD-KQFFQDHPGAVPITTAQGEELRKLIGAPIYIECSSKTQQNVKAVFDA
GM50693528   (74)  SYRGADVFILAFSLISKASYENVSKKWIPELKHYAPGVPIILVGTKLDLRDD-KQFCIDHPGAVPITTAQGEELRKLINAPAYIECSSKTQENVKAVFDA
GM52260563   (74)  SYRGADVFLLAFSLISKASYENVAKKWIPELRHYAPGVPIILVGTKLDLRDD-KQFFQDHPGAVPITTAQGEELRKLIGAPIYIECSSKTQQNVKAVFDA
OS30848846   (75)  SYRGADIFVLAFSLISRASYENVLKKWMPELRRFAPNVPIVLVGTKLDLRDH-RSYLADHPAASAITTAQGEELRKQIGAAAYIECSSKTQQNIKAVFDT
OS32558796  (101)  YYRGAAAAVVVYDITSPESFSKAQYWVKELQKHGSPDIIMVLVGMYADLHEN-----RHVSS------QEAQEYAEKN-NMVFIETSAKTADNINQVFEE
OS33960403   (76)  SYRGADVFVLAFSLVSRASYENVMKKWLPELQHYAPGVPIVLVGTKLDLRED-KHYLLDHPSLVPVTTAQGEELRKHIGATCYIECSSKTQQNVKAVFDA
OS35505384   (83)  YYREADAALLVYDITNDTFLRVTKWVKELKQMANKDIVMAIAANESDLVRS-----------KHIDTNEAASYAESIGATLFVTS-AKAGTGIDDIFSD
OS37807380   (78)  SYRGADVFILSFSLISRASYENVQKKWMPELRRFAPGVPVVLVGTKLDLRED-RAYLADHPASSIITTEQGEELRKLIGAVAYIECSSKTQRNIKAVFDT
   YNL090W   (75)  SYSKADIILIGFAVDNFESLINARTKWADEALRYCPDAPIVLVGLKKDLRQE--AHFKENATDEMVPIEDAKQVARAIGAKKYMECSALTGEGVDDVFEV
```

```
BN41992996  (173)  AIRVVLQPPKQKK----KKGKV---QKACSIL-------------
BN42135991  (173)  AIKVVLQPPKSKK-----KKKN---KNRCVFL-------------
BN42385898  (173)  AIRVVLQPPKQKK----KKSKA---QKACSIL-------------
BN42519337  (173)  AIRVALRPPKAKKK---IKPLRTKRSRTCFFF-------------
BN42557868  (187)  AIKVVLQPPTKIK----KQKRR---FRFCHAL-------------
BN43381801  (176)  AIKEVIKPVVKQKEKTQKTKKQKS-NHGCLSNVLCGRIVTRH----
BN44062474  (175)  AIKEVIKPVLKQKGKTKKKKKQQSNHHGCLSNVLCGRIVTRH----
BN44504217  (173)  AIKVVLQPPKQKK-----KKK----KNGCVFL-------------
BN45412825  (173)  AIKVVLQPPKNKKR---KKRKS---QKACSIL-------------
GM47124407  (173)  AIKVALKPPKPKKK---PR-----KKRTCTFL-------------
GM47172047  (173)  AIKVVLQPPKSKKK---GK----KKNTPCVFL-------------
GM48914268  (173)  AIKVVIQPPKLKK-----KRKT---QKACSIL-------------
GM49741326  (176)  AIRMVIKPPQKQNE---KRKKKPR---GCFLNVLCRRNIVRLK---
GM50199916  (173)  AIKVVLQPPKQKK----KKRKG---QKACSIL-------------
GM50693528  (173)  AIRVVLQPPKQKK----KKGKA---QKACSIL-------------
GM52260563  (173)  AIKVVLQPPKQKK----KKRKG---QKACSIL-------------
OS30848846  (174)  AIKVVLQPPRRRGETTMARKKTRRSTGCSLKNLMCGSACVV-----
OS32558796  (189)  IAKRLPRPTAS----------------------------------
OS33960403  (175)  AIKVVIKPPTKQRDR--KKKKTRRGCSFFCKGVMSRRRLVCFK---
OS35505384  (171)  IAKRLLERRKNSS----DGLSLAHPKKGILIVDDEPEKEPPPKCCS
OS37807380  (177)  AIKVVLQPPR---HKDVTRKKLQSSSNRPVRRYFCGSACFA-----
YNL090W     (173)  ATRTSLLMKKEPG-----------ANCCIIL--------------
```

US 8,008,545 B2

PROCESS FOR THE PRODUCTION OF FINE CHEMICALS

RELATED APPLICATIONS

This application is a national stage application (under 35 U.S.C. 371) of PCT/EP2004/008136 filed Jul. 21, 2004 which claims benefit to European application 03016672.2 filed Aug. 1, 2003 and international application PCT/US04/11887 filed Apr. 15, 2004.

SEQUENCE LISTING SUBMISSION

The Sequence Listing associated with this application is filed in electronic format via EFS-Web and hereby incorporated by reference into the specification in its entirety. The name of the text file containing the Sequence Listing is Sequence_Listing_12810_00197. The size of the text file is 950 KB, and the text file was created on Jan. 28, 2009.

BACKGROUND OF THE INVENTION

The present invention relates to a process for the production of the fine chemical in a microorgansm, a plant cell, a plant, a plant tissue or in one or more parts thereof. The invention furthermore relates to nucleic acid molecules, polypeptides, nucleic acid constructs, vectors, antisense molecules, antibodies, host cells, plant tissue, propagtion material, harvested material, plants, microorganisms as well as agricultural compositions and to their use.

Certain products and by-products of naturally-occurring metabolic processes in cells have utility in a wide array of industries, including, but not limited to, the food, feed, cosmetics, and pharmaceutical industries and agriculture. These molecules, collectively termed 'fine chemicals' include molecules such as vitamins for example vitamin A, D, E, K, $B_1$, $B_2$, $B_6$, $B_{12}$, C, pantothenic acid, biotin or folic acid; substances with vitamin-like character for example vitamin F, lipoic acid, ubiquinones, choline, myoinsositiol, vitamin U (S-methylmethionine), flavours for example vanillin, coumarin, isoeugenol, eugenol, (R)-carvone, (S)-carvone, menthol, jasmone or farnesol; nutraceuticals for example phytosterols, flavonoids, anthocyanidins, isoflavons or isoprenoids; detergents; fatty acids such as saturated fatty acids, mono unsaturated fatty acids (singular MUFA, plural MUFAS), poly unsaturated fatty acids (singular PUFA, plural PUFAS), waxes or lipids containing said fatty acids; carbohydrates for example cellulose, starch, dextrin, pectin, xanthangum, carrageenan or alginate; sugars for example monosaccharides such as glucose, fructose, manose, sorbose, ribose, ribulose, xylose, xylulose or galactose, disaccharides such as lactose, sucrose, saccharose, maltose, isomaltose or cellobiose, trisaccharides such as raffinose or maltotriose; carboxylic acids for example citric acid, α-ketoglutaric acid, ferulic acid, sinapic acid or lactic acid; carotinoids for example α-carotene, β-carotene, zeaxanthine, lutein, astaxanthine, lycopene, phytoene or phytofluene, amino acids for example lysine, threonine, methionine, tryptophane, phenylalanine or tyrosine, cofactors for example heme or quinines, enzymes for example lipases, esterases, proteases, amylases, glucosidases etc. and other compounds [as described e.g. in Kuninaka, A. (1996) Nucleotides and related compounds, p. 561-612, in Biotechnology vol. 6, Rehm et al., eds. VCH: Weinheim, in Industial Microbiology and Biotechnology, Demain et al., second edition, ASM Press Washington, D.C. 1999, in Ullmann's Encyclopedia of Industrial Chemistry, vol. A27, Vitamins, p. 443-613 (1996) VCH: Weinheim and Ong, A. S., Niki, E. & Packer, L. (1995) Nutrition, Lipids, Health, and Disease Proceedings of the UNESCO/Confederation of Scientific and Technological Associations in Malaysia, and the Society for Free Radical Research, Asia, held Sep. 1-3, 1994 at Penang, Malaysia, AOCS Press, (1995)), enzymes, and all other chemicals described in Gutcho (1983) Chemicals by Fermentation, Noyes Data Corporation, ISBN: 0818805086 and references contained therein]. Carotinoids are added for example to soft drinks, margarines or to animal feed for example to colour egg yolk or the flesh of fish. In the food industry polycarbohydrates are widely used as thickener. Polyunsaturated fatty acids are added for example to infant formulas to create a higher nutrition value of such formulas. PUFAs have for example a positive influence on the cholesterol level of the blood in humans and therefore are useful in the protection of heart diseases. Fine chemicals for example PUFAS can be isolated from animal sources such as for example fish or produced with microorganisms through the large-scale culture of microorganisms developed to produce and accumulate or secrete large quantities of one or more desired molecules.

In large scale fine chemicals are produced with microorganism in the fermentation industry, which is responsible for the manufacturing of at least five major ingredient categories: antibiotics, organic acids, amino acids, enzymes, vitamins and other related products. There are production facilities in all important areas of the world especially in Europe, the US and Asia. Companies continuously try to optimize the production processes, the organisms and thereby increasing the efficiency but, as in the case of amino acids and organic acids, with already high conversion rates based on feeded carbon source, the limitations of such work become evident. All fermentation processes depend on the efficient utilization of carbohydrates, supplied mainly in the form of oils, glucose or molasses. It is therefore the availability and pricing of these raw materials that influence the competitiveness of fermentation products versus production for example in plants. Amino acids, organic acids and vitamins are offered at very low prices. For such products the question is whether it is still economical to continue fermentation production in future. And that is frequently a question of comparing the availability and pricing of carbohydrates with the future markets.

Particularly useful organisms for the production of fine chemicals are microorganisms such as the algae, fungi, bacteria or plants. Through strain selection, a number of mutant strains of microorganisms have been developed which produce an array of desirable compounds including vitamins, amino acids, PUFAs etc. However, selection of strains improved for the production of a particular molecule is a time-consuming and difficult process.

Alternatively the production of fine chemicals can be most conveniently performed via the large scale production of plants developed to produce for example carotinoids, carbohydrates or PUFAS. For example for the production of carotinoids plants such as marigold are used. Particularly well-suited plants for this purpose are sugar producing plants such as sugar beet or sugar cane or oilseed plants containing high amounts of lipid compounds such as rapeseed, canola, linseed, soybean, sunflower, borage and evening primrose. But also other crop plants containing sugars, oils or lipids and fatty acids are well suited as mentioned in the detailed description of this invention. Through conventional breeding, a number of mutant plants have been developed which produce an array of desirable lipids and fatty acids, cofactors and enzymes. However, selection of new plant cultivars improved for the production of a particular molecule is a time-consuming and difficult process or even impossible if the compound does not naturally occur in the respective plant as for example in the case of $C_{20}$ and higher C-carbon chain polyunsaturated fatty acids.

Carbohydrates are an important dietary nutrient, which is mostly used to supply energy to the body, as well as, a carbon source for synthesis of other compounds such as fats or proteins. Furthermore mono- and disaccharides are widely used in the food and feed industry as sweetener. Saccharides have varying degrees of sweetness on a relative scale. Fructose is the sweetest. For example in the United States 22 million tons of sugar and other sweeteners were consumed in 1999. Said natural sweetener consumption includes the consumption of sugar, corn sweeteners such as high fructose corn syrup as main product and others such as honey or maple syrup. All natural sugar based sweeteners have a market shar of around 36 to 40 percent.

Whether unsaturated or saturated fatty acids are preferred in the food and feed industry depends on the intended purpose; thus, for example, lipids with unsaturated fatty acids, specifically polyunsaturated fatty acids, are preferred in human nutrition since they have a positive effect on the cholesterol level in the blood and thus on the possibility of heart disease. They are used in a variety of dietetic foodstuffs or medicaments. In addition PUFAs are commonly used in food, feed and in the cosmetic industry. Poly unsaturated ω-3- and/or ω-6-fatty acids are an important part of animal feed and human food. Because of the common composition of human food poly unsaturated ω-3-fatty acids, which are an essential component of fish oil, should be added to the food to increase the nutritional value of the food; thus, for example, poly unsaturated fatty acids such as docosahexaenoic acid or eicosapentaenoic acid are added as mentioned above to infant formula to increase its nutritional value.

Vitamins such as vitamin C, vitamin B12 or vitamin B2 are typically produced with microorganism as mentioned above in the fermentation industry. Vitamin C can be produced generally in a combined process using biotransformation steps in combination with classical chemical synthesis. In another production process vitamin C is produced by fermentation alone. In general organisms such as *Arthrobacter, Gluconobacter, Corynebacterium, Brevibacterium* or *Erwinia* are used for vitamin C production. Vitamin B2 and vitamin B12 are produced with organisms such as *Bacillus, Streptomyces, Citrobacter, Klebsiella, Propionibacterium* or *Ashbya* in large scale fermentation.

Commonly vitamin E and A are procuded in a classical chemical process or isolated from as natural vitamin E from plant oils. Vitamin E is an important natural fat-soluble antioxidants. As such, vitamin E protects cell membranes from the damage caused by free radicals. High doses of vitamin E have also been linked to a decreased ability of the blood to clot, which may be beneficial in those individuals at risk for heart disease by reducing the risk of heart attack. A vitamin E deficiency leads to pathophysiological situations in humans and animals. Of the different types of vitamin E, the alpha tocopherol form is typically considered the "gold standard" in terms of antioxidant activity—although the most recent research suggests that the other chemical forms may possess equivalent or superior antioxidant protection. Vitamin E compounds therefore are of high economical value as additives in the food and feed sectors, in pharmaceutical formulations and in cosmetic applications. Vitamin A is another fat-soluble vitamin that is part of a family of compounds including retinol, retinal and beta-carotene. Beta-carotene is also known as pro-vitamin A because it can be converted into vitamin A when additional levels are required. Vitamin A is needed by all of the body's tissues for general growth and repair processes and is especially important for bone formation, healthy skin/hair, night vision and function of the immune system. Vitamin A may help boost immune system function and resistance to infection. Vitamin A derivatives are widely used in cosmetics and dermatological treatments for skin preparations designed to combat skin aging and treat acne. Vitamin A has been used for decades as a treatment for various vision-related conditions, including night blindness, cataracts, conjunctivitis, retinopathy and macular degeneration.

An economical method for producing of vitamins such as vitamin C, B2, B12 or vitamin E and food- and feedstuffs with increased vitamin content are therefore very important. Particularly economical methods are biotechnological methods utilizing vitamin-producing organisms, which are either natural or optimized by genetic modification.

Carotenoids are a large family of compounds including over 600 members such as β-carotene, lycopene or lutein. Carotenoids are widely distributed in fruits and vegetables and are responsible, along with flavonoids, for contributing the color to many plants (a rule of thumb is the brighter, the better). In terms of nutrition, β-carotene's primary role is as mentioned above a precursor to vitamin A. β-carotene as most other carotenoids, is a powerful antioxidant—so it has been recommended to protect against a variety of diseases such as cancer, cataracts and heart disease.

The introduction of a new gene or new genes for the synthesis of fine chemicals into an organism or cell may not just increase the biosynthetic flux towards an end product it may also increase or create de novo a new compound composition. Similarly, other genes involved in the import of nutrients necessary for the biosynthesis of one or more fine chemicals (e.g., fatty acids, polar and neutral lipids, vitamins, enzymes etc.) may be increased in number or activity such that these precursors, cofactors, or intermediate compounds are increased in concentration within the cell or within the storing compartment thus increasing further the capability of the cell to produce the fine chemical as described herein.

Amino acids are used in many branches of industry, including the food, animal feed, cosmetics, pharmaceutical and chemical industries. Amino acids such as D,L-methionine, L-lysine or L-threonine are used in the animal feed industry. The essential amino acids valine, leucine, isoleucine, lysine, threonine, methionine, tyrosine, phenylalanine and tryptophan are particularly important for the nutrition of mammals especially humans and a number of livestock species. Glycine, L-methionine and tryptophan are all used in the pharmaceutical industry. Glutamine, valine, leucine, isoleucine, histidine, arginine, proline, serine and alanine are used in the pharmaceutical and cosmetics industries. Threonine, tryptophan and D,L-methionine are widely used feed additives (Leuchtenberger, W. (1996) Amino acids—technical production and use, pp. 466-502 in Rehm et al., (Ed.) Biotechnology vol. 6, chapter 14a, VCH Weinheim). Moreover, amino acids are suitable for the chemical industry as precursors for the synthesis of synthetic amino acids and proteins, such as N-acetylcysteine, S-carboxymethyl-L-cysteine, (S)-5-hydroxytryptophan and other subtances described in Ullmann's Encyclopedia of Industrial Chemistry, vol. A2, pp. 57-97, VCH Weinheim, 1985. To prefent physiological malnutritions the human body has a need for essentiall amino acids such as arginine, histidine, isoleucine, leucine, lysine, methionine, tyrosine, phenylalanine, threonine, tryptophan, and valine. Based on their content of amino acids, foods are often classified as complete, partially complete, or incomplete protein sources. In order for a protein to be complete, it must contain all of the essential amino acids. This is the reason that many nutritionists rank non-meat foods as being incomplete. The foods do contain all amino acids, but some may be in lower proportions than are required, and, therefore, should be combined with another food containing higher amounts of these amino acids or should be supplemented with said essential amino acids.

Over one million tonnes of amino acids are currently produced annually; their market value amounts to over 2.5 billion US dollars. They are currently produced by four competing processes: Extraction from protein hydrolysates, for example L-cystine, L-leucine or L-tyrosine, chemical synthesis, for example of D,L-methionine, conversion of chemical precursors in an enzyme or cell reactor, for example L-phenylalanine, and fermentative production by growing, on an industrial scale, bacteria which have been developed to produce and secrete large amounts of the desired molecule in question. An organism, which is particularly suitable for this purpose is *Corynebacterium glutamicum*, which is used for example for the production of L-lysine or L-glutamic acid. Other amino acids which are produced by fermentation are, for example, L-threonine, L-tryptophan, L-aspartic acid and L-phenylalanine.

The biosynthesis of the natural amino acids in organisms capable of producing them, for example bacteria, has been characterizied thoroughly; for a review of the bacterial amino acid biosynthesis and its regulation, see Umbarger, H. E. (1978) Ann. Rev. Biochem. 47: 533-606].

It is known that amino acids are produced by fermentation of strains of coryneform bacteria, in particular *Corynebacterium glutamicum*. Due to their great importance, the production processes are constantly being improved. Process improvements can relate to measures regarding technical aspects of the fermentation, such as, for example, stirring and oxygen supply, or the nutrient media composition, such as, for example, the sugar concentration during fermentation, or to the work-up to give the product, for example by ion exchange chromatography, or to the intrinsic performance properties of the microorganism itself. Bacteria from other genera such as *Escherichia* or *Bacillus* are also used for the production of amino acids. A number of mutant strains, which produce an assortment of desirable compounds from the group of the sulfur-containing fine chemicals have been developed via strain selection. The performance properties of said microorganisms are improved with respect to the production of a particular molecule by applying methods of mutagenesis, selection and mutant selection. Methods for the production of methionine have also been developed. In this manner, strains are obtained which are, for example, resistant to antimetabolites, such as, for example, the methionine analogues α-methylmethionine, ethionine, norleucine, N-acetyl-norleucine, S-trifluoromethylhomocysteine, 2-amino-5-heprenoitic acid, selenomethionine, methionine sulfoximine, methoxine, 1-aminocyclopentanecarboxylic acid or which are auxotrophic for metabolites with regulatory importance and which produce sulfur-containing fine chemicals such as, for example, L-methionine. However, such processes developed for the production of methionine have the disadvantage that their yields are too low for being economically exploitable and that they are therefore not yet competitive with regard to chemical synthesis.

Zeh (Plant Physiol., Vol. 127, 2001: 792-802) describes increasing the methionine content in potato plants by inhibiting threonine synthase by what is known as antisense technology. This leads to a reduced threonine synthase activity without the threonine content in the plant being reduced. This technology is highly complex; the enzymatic activity must be inhibited in a very differentiated manner since otherwise auxotrophism for the amino acid occurs and the plant will no longer grow.

U.S. Pat. No. 5,589,616 teaches the production of higher amounts of amino acids in plants by overexpressing a monocot storage protein in dicots. WO 96/38574, WO 97/07665, WO 97/28247, U.S. Pat. No. 4,886,878, U.S. Pat. No. 5,082,993 and U.S. Pat. No. 5,670,635 are following this approach. That means in all the aforementioned intellectual property rights different proteins or polypeptides are expressed in plants. Said proteins or polypeptides should function as amino acid sinks. Other methods for increasing amino acids such as lysine are disclosed in WO 95/15392, WO 96/38574, WO 89/11789 or WO 93/19190. In this cases speziell enzymes in the amino acid biosynthetic pathway such as the diphydrodipicolinic acid synthase are deregulated. This leads to an increase in the production of lysine in the different plants. Another approach to increase the level of amino acids in plants is disclosed in EP-A-0 271 408. EP-A-0 271 408 teaches the mutagenensis of plant and selection afterwards with inhibitors of certain enzymes of amino acid biosynthetic pathway.

Methods of recombinant DNA technology have also been used for some years to improve *Corynebacterium* strains producing L-amino acids by amplifying individual amino acid biosynthesis genes and investigating the effect on amino acid production.

As described above, the essential amino acids are necessary for humans and many mammals, for example for livestock. L-methionine is important as methyl group donor for the biosynthesis of, for example, choline, creatine, adrenaline, bases and RNA and DNA, histidine, and for the transmethylation following the formation of S-adenosylmethionine or as a sulfhydryl group donor for the formation of cysteine. Moreover, L-methionine appears to have a positive effect in depression.

Improving the quality of foodstuffs and animal feeds is an important task of the food-and-feed industry. This is necessary since, for example, certain amino acids, which occur in plants are limited with regard to the supply of mammals. Especially advantageous for the quality of foodstuffs and animal feeds is as balanced as possible an amino acid profile since a great excess of an amino acid above a specific concentration in the food has no further positive effect on the utilization of the food since other amino acids suddenly become limiting. A further increase in quality is only possible via addition of further amino acids, which are limiting under these conditions. The targeted addition of the limiting amino acid in the form of synthetic products must be carried out with extreme caution in order to avoid amino acid imbalance. For example, the addition of an essential amino acid stimulates protein digestion, which may cause deficiency situations for the second or third limiting amino acid, in particular. In feeding experiments, for example casein feeding experiments, the additional provision of methionine, which is limiting in casein, has revealed the fatty degeneration of liver, which could only be alleviated after the additional provision of tryptophan.

To ensure a high quality of foods and animal feeds, it is therefore necessary to add fine chemicals that means a plurality of compounds such as amino acids, vitamins, organic acids, PUFAS etc. in a balanced manner to suit the organism. Such supplemented food is named as "functional foods" or "nutraceuticals". Nutraceuticals shall provide a health benefit to humans beyond basic nutrition. Functional foods have health-promoting or disease-preventing effects. Examples include omega-3 fatty acids (found in many fish, flaxseed oil, soybean oil, canola oil, and walnuts), which reduce risk of coronary heart disease and lycopene in tomatoes, which has been associated with reduced risk of certain cancers.

From a practical standpoint it would be of great advantage to produce an organism such as a microorganism or a plant containing a combination of different fine chemicals such as amino acids, vitamins, organic acids, carotenoids, PUFAS etc. at the same time in an sufficient amount to provide optimal growth and health benefit to animals or humans instead of combining different food or supplementing food or feed with different fine chemicals.

BRIEF SUMMARY OF THE INVENTION

It is therefore an object of the present invention to develop an inexpensive process for the synthesis of a combination of fine chemicals such as amino acids like tryptophane, proline, arginine, phenylalanine, tyrosine, alanine, glycine, threonine, serine, valine, isoleucine or leucine especially essential amino acids such as tryptophane, arginine, phenylalanine, tyrosine, threonine, valine, isoleucine or leucine, carbohydrates such as raffinose, maltose or inositol, vitamins such as γ-, α- or β-tocopherol, organic acids such as ferulic acid, malate or sinapic acid, carotenoids such as β-carotene etc. at the same time in an sufficient amount to provide optimal growth and health benefit to animals or humans

BRIEF DESCRIPTION OF THE DRAWINGS

FIG. 1 shows a protein alignment of Rho small GTPases from *Oryza sativa* cv. Noppon-Brarre (a japonica rice), *Brassica napus* cv. "AC Excel" "Quantum" and "Cresor" (canola), and *Glycine max* cv. Resuick (soybean) (BN41992996 (SEQ ID NO: 38), BN42135991 (SEQ ID NO: 8), BN42385898 (SEQ ID NO: 46), BN42519337 (SEQ ID NO: 32), BN42557868 (SEQ ID NO: 34), BN43381801 (SEQ ID NO: 401), BN44062474 (SEQ ID NO: 30), BN44504217 (SEQ ID NO: 36), BN45412825 (SEQ ID NO: 10), GM47124407 (SEQ ID NO: 12), GM47172047 (SEQ ID NO: 14), GM48914268 (SEQ ID NO: 16), GM49741326 (SEQ ID NO: 24), GM50199916 (SEQ ID NO: 22), GM50693528 (SEQ ID NO: 18), GM52260563 (SEQ ID NO: 20), OS30848846 (SEQ ID NO: 42), OS32558796 (SEQ ID NO: 4), OS33960403 (SEQ ID NO: 6), OS35505384 (SEQ ID NO: 44), OS37807380 (SEQ ID NO: 40), and YNL090W (SEQ ID NO: 2)). Boxes (doted line) represent the conserved sequences.

DETAILED DESCRIPTION OF THE INVENTION

It was now found that this object is achieved by providing the process according to the invention described herein and the embodiments characterized in the claims.

Accordingly, in a first embodiment, the invention relates to a process for the production of a fine chemical, whereby the fine chemical is at least one compound selected from the group consisting of tryptophane, proline, arginine, phenylalanine, tyrosine, alanine, glycine, threonine, serine, valine, isoleucine, leucine, raffinose, maltose, inositol, ferulic acid, malate, γ-tocopherol, α-tocopherol, β-tocopherol, cerotic acid, lignoceric acid, putrescine, sinapic acid, 3,4-dihydroxyphenylaline (=DOPA), stearic acid and β-carotene. Accordingly, in the present invention, the term "the fine chemical" as used herein relates to an amino acid selected from the group consisting of tryptophane, proline, arginine, phenylalanine, tyrosine, alanine, glycine, threonine, serine, valine, isoleucine and leucine; a vitamin selected from the group consisting of γ-tocopherol, α-tocopherol and β-tocopherol, a fatty acid selected from the group consisting of cerotic acid, lignoceric acid and stearic acid, an organic acid selected from the group consisting of ferulic acid, malate and sinapic acid or a compound selected from the group consisting of raffinose, putrescine, 3,4-dihydroxyphenylaline (=DOPA) and β-carotene or mixtures thereof containing at least two, three, four or five compounds selected from the aforementioned groups, preferably 6, 7, 8 or 9 compounds selected from the aforementioned groups, most preferably 10, 11, 12, 13, 14, 15, 16, 17 or more compounds selected from the aforementioned groups. Further, the term "the fine chemicals" as used herein also relates to fine chemicals comprising at least one compound selected from the group consisting of tryptophane, proline, arginine, phenylalanine, tyrosine, alanine, glycine, threonine, serine, valine, isoleucine, leucine, raffinose, maltose, inositol, ferulic acid, malate, γ-tocopherol, α-tocopherol, β-tocopherol, cerotic acid, lignoceric acid, putrescine, sinapic acid, 3,4-dihydroxyphenylaline (=DOPA), stearic acid and β-carotene.

In one embodiment, the term "the fine chemical" or "fine chemical" means at least one compound selected from the group consisting of L-tryptophane, L-proline, L-arginine, L-phenylalanine, L-tyrosine, L-alanine, glycine, L-threonine, L-serine, L-valine, L-isoleucine, L-leucine, raffinose, maltose, inositol, ferulic acid, malate, γ-tocopherol, α-tocopherol, β-tocopherol, cerotic acid, lignoceric acid, putrescine, sinapic acid, 3,4-dihydroxyphenylaline (=DOPA), stearic acid and β-carotene. Throughout the specification the term "the fine chemical" means the aforementioned compounds, its salts, ester or amids in free form or bound to other chemical compounds especially proteins. In a preferred embodiment, the term "the fine chemical" or "fine chemical" means at least one compound selected from the group consisting of L-tryptophane, L-proline, L-arginine, L-phenylalanine, L-tyrosine, L-alanine, glycine, L-threonine, L-serine, L-valine, L-isoleucine and L-leucine in free form or its salts or bound to proteins.

Accordingly, the present invention relates to a process for the production of fine chemical comprising (a) increasing or generating the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 in a non-human organism, or in one or more parts thereof; and (b) growing the organism under conditions which permit the production of the fine chemical in said organism.

Comprises/comprising and grammatical variations thereof when used in this specification are to be taken to specify the presence of stated features, integers, steps or components or groups thereof, but not to preclude the presence or addition of one or more other features, integers, steps, components or groups thereof.

Preferably, this process further comprises the step of recovering the fine chemical, which is synthesized by the organism from the organism and/or from the culture medium used for the growth or maintainance of the organism. The term "recovering" means the isolation of the fine chemical in different purities, that means on the one hand harvesting of the biological material, which contains the fine chemical without further purification and on the other hand purities of the fine chemical between 5% and 100% purity, preferred purities are in the range of 10% and 99%. In one embodiment, the purities are 20%, 30%, 40%, 50%, 60%, 70%, 80%, 90%, 95% or 99% or more.

Advantageously the process for the production of the fine chemical leads to an enhanced production of the fine chemical. The terms "enhanced" or "increase" mean at least a 10%, 20%, 30%, 40% or 50%, preferably at least 60%, 70%, 80%, 90% or 100%, more preferably 150%, 200%, 300%, 400% or 500% higher production of the fine chemical in comparison to the reference as defined below, e.g. that means in comparison to an organism without the aforementioned modification of the activity of a protein having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394.

Surprisingly it was found, that the transgenic expression of the *Kluyveromyces lactis, Cryptococcus neoformans, Neurospora crassa, Penicillium marneffei, Mucor rouxii, Schizophyllum commune, Paracoccidioides brasiliensis, Aspergillus fumigatus, Suillus bovinus, Candida albicans, Trichoderma reesei, Ashbya gossypii, Yarrowia lipolytica, Ustilago maydis, Emericella nidulans, Trichomonas vaginalis, Colletotrichum trifolii, Blumeria graminis, Dictyostelium discoideum, Saccharomyces cerevisiae, Schizosaccharomyces pombe, Entamoeba histolytica, Oryza sativa, Brassica napus, Glycine max, Beta vulgaris, Lotus japonicus, Zinnia elegans, Zea mays, Cicer arietinum, Arabidopsis thaliana, Hordeum vulgare, Nicotiana tabacum, Gossypium hirsutum, Physcomitrella patens, Fucus distichus, Medicago truncutula, Homo sapiens, Caenorhabditis elegans, Tigriopus japonicus, Rhopalosiphum padi, Mus musculus, Discopyge ommata, Canis lupus, Drosophila melanogaster, Anopheles gambiae, Aplysia california, Ciona savignyi, Ciona intestinalis, Hemicentrotus pulcherrimus, Giardia lamblia, Gallus gallus, Brachydanio rerio, Xenopus laevis, Xenopus tropicalis, Schistosoma japonicum, Schistosoma mansoni, Encephalitozoon cuniculi, Wuchereria bancrofti, Cavia porcellus, Sus scrofa, Rattus norvegicus, Pneumocystis carinii* or *Pagrus major* proteins as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 for example in *Arabidopsis thaliana* conferred an increase in the fine chemical content of the transformed plants.

In accordance with the invention, the term "organism" as understood herein relates always to a non-human organism, in particular to an animal or plant organism or to a microorganism. Further, the term "animal" as understood herein relates always to a non-human animal.

The sequence depicted in SEQ ID NO: 1 (YNL090W) from *Saccharomyces cerevisiae* has been published in Madaule et al. [1987, "Characterization of two members of the rho gene family from the yeast *Saccharomyces cerevisiae*"; Proc. Natl. Acad. Sci., USA 84(3):779-83], and named as rho2. The gene encodes as all the other sequences mentioned above and use in the inventive process a non-essential GTPase of the rho/rac subfamily of the ras-like GTPases. The protein may play a role in the establishment of cell polarity or in microtubule assembly. Accordingly, in one embodiment, the process of the present invention comprises the use of a gene product "involved in in the establishment of cell polarity or in microtubule assembly" from *Saccharomyces cerevisiae* or its homolog, e.g. as shown herein, for the production of the fine chemical, meaning of preferably for the production of essential amino acids, in particular for increasing the amount of an essential amino acid in free or bound form in an organism or a part thereof, as mentioned herein. That means the increase of its biological activity by overexpression of the responsible gene leads to an increase of the fine chemical.

The term "biological activity" means the biological function of the protein of the invention. In contrast to the term "biological activity" the term "activity" means the increase in the production of the compound produced by the inventive process. The term "biological activity" preferably refers to for example the enzymatic function, transporter or carrier function, DNA-packaging function, heat shock protein function, recombination protein function or regulatory function of a peptide or protein in an organism, a tissue, a cell or a cell compartment. Suitable substrates are low-molecular-weight compounds and also the protein interaction partners of a protein. The term "increase" of the biological function refers, for example, to the increase in binding capacity or binding strength of a protein for at least one substrate in an organism, a tissue, a cell or a cell compartment—for example by one of the methods described herein below—in comparison with the wild type of the same genus and species to which this method has not been applied, under otherwise identical conditions (such as, for example, culture conditions, age of the plants and the like). Increase is also understood as meaning the modification of the substrate specificity as can be expressed for example, by the kcat/Km value. In this context, an increase of the function of at least 10%, advantageously of at least 20%, preferably at least 30%, especially preferably of at least 40%, 50%, 60%, 70%, 80%, 90% or more, very especially preferably of at least 150%, 200%, 250%, 300% or more, in comparison with the untreated organism is advantageous.

Homologues (=homologs) of the present gene products can be derived from any organisms as long as the homologue confers the herein mentioned activity, in particular, confers an increase in the fine chemical amount or content. Further, in the present invention, the term "homologue" relates to the sequence of an organism having the highest sequence homology to the herein mentioned or listed sequences of all expressed sequences of said organism. However, the person skilled in the art knows, that preferably, the homologue has said the fine chemical increasing activity and, if known, the same biological function or activity in the organism as the YNL090W protein as depicted in SEQ ID NO: 2. In one embodiment, the homolog of the SEQ ID NO: 2 is a homolog having said biological activity and being derived from Eukaryot such as plants like the families Anacardiaceae, Asteraceae, Apiaceae, Betulaceae, Boraginaceae, Brassicaceae, Bromeliaceae, Caricaceae, Cannabaceae, Convolvulaceae, Chenopodiaceae, Cucurbitaceae, Elaeagnaceae, Ericaceae, Euphorbiaceae, Fabaceae, Geraniaceae, Gramineae, Juglandaceae, Lauraceae, Leguminosae or Linaceae; algae, fungi or mosses. In another embodiment, the homolog of SEQ ID NO: 2 is a homolog having said activity and being derived from bacteria. In a further embodiment, the homolog of the SEQ ID NO: 2 is a homolog having said activity and being derived from fungi. I Further homologs of are described herein below.

In accordance with the invention, a protein or polypeptide has the "the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394" if its de novo activity, or its increased expression directly or indirectly leads to an increased the fine chemical level in the organism or a part thereof, preferably in a cell of said organism and the protein has the above mentioned activities of a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394. During the specification the activity or preferably the biological activity of such a protein or polypeptide or an nucleic acid molecule or sequence encoding such protein or polypeptide is identical or similar if it still has the biological or enzymatic activity of a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394, if it has at least 10% of the original biological or enzymatic activity, preferably 20%, particularly preferably 30%, most particularly preferably 40% in comparison to a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 of *Kluyveromyces lactis, Cryptococcus neoformans, Neurospora crassa, Penicillium marneffei, Mucor rouxii, Schizophyllum commune, Paracoccidioides brasiliensis, Aspergillus fumigatus, Suillus bovinus, Candida albicans, Trichoderma reesei, Ashbya gossypii, Yarrowia lipolytica, Ustilago maydis, Emericella nidulans, Trichomonas vaginalis, Colletotrichum trifolii, Blumeria graminis, Dictyostelium discoideum, Saccaromyces cerevisiae, Schizosaccharomyces pombe, Entamoeba histolytica, Oryza sativa, Brassica napus, Glycine max, Beta vulgaris, Lotus japonicus, Zinnia elegans, Zea mays, Cicer arietinum, Arabidopsis thaliana, Hordeum vulgare, Nicotiana tabacum, Gossypium hirsutum, Physcomitrella patens, Fucus distichus, Medicago truncatula, Homo sapiens, Caenorhabditis elegans, Tigriopus japonicus, Rhopalosiphum padi, Mus musculus, Discopyge ommata, Canis lupus, Drosophila melanogaster, Anopheles gambiae, Aplysia california, Ciona savignyi, Ciona intestinalis, Hemicentrotus pulcherrimus, Giardia lamblia, Gallus gallus, Brachydanio rerio, Xenopus laevis, Xenopus tropicalis, Schistosoma japonicum, Schistosoma mansoni, Encephalitozoon cuniculi, Wuchereria bancrofti, Cavia porcellus, Sus scrofa* and/or *Pagrus major.*

The terms "increased", "rised", "extended", "enhanced", "improved" or "amplified" relate to a corresponding change of a property in an organism, a part of an organism such as a tissue, seed, root, leave, flower etc. or in a cell and are interchangeable. Preferably, the overall activity in the volume is increased or enhanced in cases if the increase or enhancement is related to the increase or enhancement of an activity of a gene product, independent whether the amount of gene product or the specific activity of the gene product or both is increased or enhanced or whether the amount, stability or translation efficacy of the nucleic acid sequence or gene encoding for the gene product is increased or enhanced. The terms "reduction", "decrease" or "deletion" relate to a corresponding change of a property in, an organism, a part of an organism such as a tissue, seed, root, leave, flower etc. or in a cell. Preferably, the overall activity in the volume is reduced, decreased or deleted in cases if the reduction, decrease or deletion is related to the reduction, decrease or deletion of an activity of a gene product, independent whether the amount of gene product or the specific activity of the gene product or both is reduced, decreased or deleted or whether the amount, stability or translation efficacy of the nucleic acid sequence or gene encoding for the gene product is reduced, decreased or deleted.

The terms "increase" or "decrease" relate to a corresponding change of a property an organism or in a part of an organism, such as a tissue, seed, root, leave, flower etc. or in a cell. Preferably, the overall activity in the volume is increased in cases the increase relates to the increase of an activity of a gene product, independent whether the amount of gene product or the specific activity of the gene product or both is increased or generated or whether the amount, stability or translation efficacy of the nucleic acid sequence or gene encoding for the gene product is increased.

Under "change of a property" it is understood that the activity, expression level or amount of a gene product or the metabolite content is changed in a specific volume relative to a corresponding volume of a control, reference or wild type, including the de novo creation of the activity or expression.

The terms "increase" or "decrease" include the change of said property in only parts of the subject of the present invention, for example, the modification can be found in compartment of a cell, like a organelle, or in a part of a plant, like tissue, seed, root, leave, flower etc. but is not detectable if the overall subject, i.e. complete cell or plant, is tested. Preferably, the increase or decrease is found cellular, thus the term "increase of an activity" or "increase of a metabolite content" relates to the cellular increase compared to the wild typ cell. Typically said increase is based on the higher content of the transcribed nucleic acid or the protein translated from said nucleic acid sequence in the modified cell in comparison to the wild type cell.

Accordingly, the term "increase" or "decrease" means that the specific activity of an enzyme as well as the amount of a compound or metabolite, e.g. of a polypeptide, a nucleic acid molelcule or of the fine chemical of the invention or an encoding mRNA or DNA, can be increased or decreased in a volume.

The terms "wild type", "control" or "reference" are exchangeable and can be a cell or a part of organisms such as an organelle or a tissue, or an organism, in particular a microorganism or a plant, which was not modified or treated according to the herein described process according to the invention. Accordingly, the cell or a part of organisms such as an organelle or a tissue, or an organism, in particular a microorganism or a plant used as wild typ, control or reference corresponds to the cell, organism or part thereof as much as possible and is in any other property but in the result of the process of the invention as identical to the subject matter of the invention as possible. Thus, the wild type, control or reference is treated identically or as identical as possible, saying that only conditions or properties might be different which do not influence the quality of the tested property.

Preferably, any comparison is carried out under analogous conditions. The term "analogous conditions" means that all conditions such as, for example, culture or growing conditions, assay conditions (such as buffer composition, temperature, substrates, pathogen strain, concentrations and the like) are kept identical between the experiments to be compared.

The "reference", "control", or "wild type" is preferably a subject, e.g. an organelle, a cell, a tissue, an organism, in particular a plant or a microorganism, which was not modified or treated according to the herein described process of the invention and is in any other property as similar to the subject matter of the invention as possible. The reference, control or wild type is in its genome, transcriptome, proteome or metabolome as similar as possible to the subject of the present invention. Preferably, the term "reference-" "control-" or "wild type-"-organelle, -cell, -tissue or -organism, in particular plant or microorganism, relates to an organelle, cell, tissue or organism, in particular plant or micororganism, which is nearly genetically identical to the organelle, cell, tissue or organism, in particular microorganism or plant, of the present invention or a part thereof preferably 95%, more peferred are 98%, even more preferred are 99.00%, in particular 99.10%, 99.30%, 99.50%, 99.70%, 99.90%, 99.99%, 99.999% or more. Most preferable the "reference", "control", or "wild type" is a subject, e.g. an organelle, a cell, a tissue, an organism, which is genetically identical to the organism, cell or organelle used according to the process of the invention except that the responsible or acvitivity conferring nucleic acid molecules or the gene product encoded by them are amended, manipulated, exchanged or introduced according to the inventive process.

Preferably, the reference, control or wild type differs form the subject of the present invention only in the cellular activity of the polypeptide of the invention, e.g. as result of an increase in the level of the nucleic acid molecule of the present invention or an increase of the specific activity of the polypeptide of the invention, e.g. by or in the expression level or activity of an protein having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or its homologs, its biochemical or genetical causes and the increased amount of the fine chemical.

In case, a control, reference or wild type differing from the subject of the present invention only by not being subject of the process of the invention can not be provided, a control, reference or wild type can be an organism in which the cause for the modulation of an activity conferring the increase of the fine chemical or expression of the nucleic acid molecule of the invention as described herein has been switched back or off, e.g. by knocking out the expression of responsible gene product, e.g. by antisense inhibition, by inactivation of an activator or agonist, by activation of an inhibitor or antagonist, by inhibition through adding inhibitory antibodies, by adding active compounds as e.g. hormones, by introducing negative dominant mutants, etc. A gene production can for example be knocked out by introducing inactivating point mutations, which lead to an enzymatic activity inhibition or a destabilization or an inhibition of the ability to bind to cofactors etc.

Accordingly, preferred reference subject is the starting subject of the present process of the invention. Preferably, the reference and the subject matter of the invention are compared after standardization and normalization, e.g. to the amount of total RNA, DNA, or protein or activity or expression of reference genes, like housekeeping genes, such as ubiquitin, actin or ribosomal proteins.

A series of mechanisms exists via which a modification of the protein, e.g. the polypeptide of the invention can directly or indirectly affect the yield, production and/or production efficiency of the amino acid.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein. However, it is also possible to increase the expression of the gene which is naturally present in the organisms, for example by modifying the regulation of the gene, or by increasing the stability of the corresponding mRNA or of the corresponding gene product encoded by the nucleic acid molecule of the invention, or by introducing homologous genes from other organisms which are differently regulated, eg. not feedback sensitive or not feedback regulated.

This also applies analogously to the combined increased expression of the nucleic acid molecule of the present invention or its gene product with that of further enzymes of the biochemical pathway of the fine chemical e.g. of the amino acid biosynthesis pathway, e.g. which are useful for the synthesis of the fine chemicals.

The increase, decrease or modulation according to this invention can be constitutive, e.g. due to a stable permanent transgenic expression or to a stable mutation in the corresponding endogenous gene encoding the nucleic acid molecule of the invention or to a modulation of the expression or of the behaviour of a gene conferring the expression of the polypeptide of the invention, or transient, e.g. due to an transient transformation or temporary addition of a modulator such as a agonist or antagonist or inducible, e.g. after transformation with a inducible construct carrying the nucleic acid molecule of the invention under control of a induceable promoter and adding the inducer, e.g. tetracycline or as described herein below.

The increase in activity of the polypeptide amounts in a cell, a tissue, a organelle, an organ or an organism or a part thereof preferably to at least 5%, preferably to at least 20% or at to least 50%, especially preferably to at least 70%, 80%, 90% or more, very especially preferably are to at least 200%, 300% or 400%, most preferably are to at least 500%, 600% or more in comparison to the control, reference or wild type.

The specific activity of a polypeptide encoded by a nucleic acid molecule of the present invention or of the polypeptide of the present invention can be tested as described in the examples. In particular, the expression of a protein in question in a cell, e.g. a plant cell or a microorganism and the detection of an increase the fine chemical level in comparison to a control is an easy test and can be performed as described in the state of the art.

The term "increase" includes, that a compound or an activity is introduced into a cell de novo or that the compound or the activity has not been detectable before, in other words it is "generated".

Accordingly, in the following, the term "increasing" also comprises the term "generating" or "stimulating". The increased activity manifests itself in an increase of the fine chemical.

In case the biological activity of the *Saccharomyces cerevisiae* protein YNL090W as depicted in SEQ ID NO: 2, or the biological activity of the of *Kluyveromyces lactis, Cryptococcus neoformans, Neurospora crassa, Penicillium marneffei, Mucor rouxii, Schizophyllum commune, Paracoccidioides brasiliensis, Aspergillus fumigatus, Suillus bovinus, Candida albicans, Trichoderma reesei, Ashbya gossypii, Yarrowia lipolytica, Ustilago maydis, Emericella nidulans, Trichomonas vaginalis, Colletotrichum trifolii, Blumeria graminis, Dictyostelium discoideum, Schizosaccharomyces pombe, Entamoeba histolytica, Oryza sativa, Brassica napus, Glycine max, Beta vulgaris, Lotus japonicus, Zinnia elegans, Zea mays, Cicer arietinum, Arabidopsis thaliana, Hordeum vulgare, Nicotiana tabacum, Gossypium hirsutum, Physcomitrella patens, Fucus distichus, Medicago truncutula, Homo sapiens, Caenorhabditits elegans, Tigriopus japonicus, Rhopalosiphum padi, Mus musculus, Discopyge ommata, Canis lupus, Drosophila melanogaster, Anopheles gambiae, Aplysia california, Ciona savignyi, Ciona intestinalis, Hemicentrotus pulcherrimus, Giardia lamblia, Gallus gallus, Brachydanio rerio, Xenopus laevis, Xenopus tropicalis, Schistosoma japonicum, Schistosoma mansoni, Encephalitozoon cuniculi, Wuchereria bancrofti, Cavia porcellus, Sus scrofa, Rattus norvegicus, Pneumocystis carinii* or *Pagrus major* proteins as depicted SEQ ID NO: 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or its homologs is increased, preferably, in one embodment an increase of the fine chemical of at least 100%, 150%, or preferably to at least 200%, 250%, 300%, 350% or 400%, especially prerferably to at least 450%, 500%, 550%, 600% or more is conferred.

In case the biological activity of the *Saccaromyces cerevisiae* protein YNL090W as depicted in SEQ ID NO: 2, or the biological activity of the *Kluyveromyces lactis, Cryptococcus neoformans, Neurospora crassa, Penicillium marneffei, Mucor rouxii, Schizophyllum commune, Paracoccidioides brasiliensis, Aspergillus fumigatus, Suillus bovinus, Candida albicans, Trichoderma reesei, Ashbya gossypii, Yarrowia lipolytica, Ustilago maydis, Emericella nidulans, Trichomonas vaginalis, Colletotrichum trifolii, Blumeria graminis, Dictyostelium discoideum, Schizosaccharomyces pombe, Entamoeba histolytica, Oryza sativa, Brassica napus, Glycine max, Beta vulgaris, Lotus japonicus, Zinnia elegans, Zea mays, Cicer arietinum, Arabidopsis thaliana, Hordeum vulgare, Nicotiana tabacum, Gossypium hirsutum, Physcomitrella patens, Fucus distichus, Medicago truncutula, Homo sapiens, Caenorhabditits elegans, Tigriopus japonicus, Rhopalosiphum padi, Mus musculus, Discopyge ommata, Canis lupus, Drosophila melanogaster, Anopheles gambiae, Aplysia california, Ciona savignyi, Ciona intestinalis, Hemicentrotus pulcherrimus, Giardia lamblia, Gallus gallus, Brachydanio rerio, Xenopus laevis, Xenopus tropicalis, Schistosoma japonicum, Schistosoma mansoni, Encephalitozoon cuniculi, Wuchereria bancrofti, Cavia porcellus, Sus scrofa, Rattus norvegicus, Pneumocystis carinii* or *Pagrus major* proteins as depicted SEQ ID NO: 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or its homologs is increased, preferably, an increase of the fine chemical in conferred, preferably of the fine chemical such as essential amino acids e.g. tryptophane, arginine, phenylalanine, tyrosine, threonine, valine, isoleucine and/or leucine, non-essential amino acids e.g. proline, alanine, glycine or serine, modified amino acids e.g. 3,4-dihydroxyphenylalanine, carbohydrates e.g. raffinose, inositol or iso-maltose, vitamins e.g. α-tocopherol, β-tocopherol or γ-tocopherol, organic acids e.g. ferulic acid, sinapic acid or malate, fatty acids e.g. cerotic acid, lignoceric acid, 2-hydroxy-palmitic acid or stearic acid, carotinoids e.g. β-carotene or mixtures thereof is conferred.

In this context, the fine chemical amount in a cell, preferably in a tissue, more preferred in a organism as a plant or a microorganim or part thereof, is increased by at least 3%, 4%, 5%, 6%, 7%, 8% or 9% or more, especially preferably are at least 10%, 20%, 40%, 50% or more, very especially preferably are more than 60%, 70%, 80%, 90%, 100% or more and most preferably are 150% or more, such as 200%, 250%, 300%, 350%, 400%, 450%, 500%, 550% or 600%.

The fine chemical can be contained in the organism either in its free form and/or bound to proteins, polypeptides or other compounds such as polysaccharides, lipids, glycoproteins or glycolipids etc. or mixtures thereof. Accordingly, in one embodiment, the amount of the free form in a cell, preferably in a tissue, more preferred in a organism as a plant or a microorganim or part thereof, is increased by at least 3%, 4%, 5%, 6%, 7%, 8% or 9% or more, especially preferably are at least 10%, 20%, 40%, 50% or more, very especially preferably are more than 60%, 70%, 80%, 90%, 100% or more and most preferably are 150% or more, such as 200%, 250%, 300%, 350%, 400%, 450%, 500%, 550% or 600%. Accordingly, in an other embodiment, the amount of the bound the fine chemical in a cell, preferably in a tissue, more preferred in a organism as a plant or a microorganism or part thereof, is increased by at least 3%, 4%, 5%, 6%, 7%, 8% or 9% or more, especially preferably are at least 10%, 20%, 40%, 50% or more, very especially preferably are more than 60%, 70%, 80%, 90%, 100% or more and most preferably are 150% or more, such as 200%, 250%, 300%, 350%, 400%, 450%, 500%, 550% or 600%.

A protein having an activity conferring an increase in the amount or level of the fine chemical preferably has the structure of the polypeptide described herein, in particular of the polypeptides comprising the consensus sequence shown in SEQ ID NO: 47, SEQ ID NO: 48, SEQ ID NO: 49, SEQ ID NO: 50, SEQ ID NO: 51, SEQ ID NO: 52, SEQ ID NO: 397, SEQ ID NO: 398, SEQ ID NO: 399 and/or SEQ ID NO: 400 as described herein, or is encoded by the nucleic acid molecule characterized herein or the nucleic acid molecule according to the invention, for example by the nucleic acid molecule as shown in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 or its herein described functional homologues and has the herein mentioned activity.

For the purposes of the present invention, the terms "the fine chemical" or "fine chemical" such as essential amino acids e.g. tryptophane, arginine, phenylalanine, tyrosine, threonine, valine, isoleucine and/or leucine, non-essential amino acids e.g. proline, alanine, glycine or serine, modified amino acids e.g. 3,4-dihydroxyphenylalanine, carbohydrates e.g. raffinose, inositol or iso-maltose, vitamins e.g. α-tocopherol, β-tocopherol or γ-tocopherol, organic acids e.g. ferulic acid, sinapic acid or malate, fatty acids e.g. cerotic acid, lignoceric acid, 2-hydroxy-palmitic acid or stearic acid, carotinoids e.g. β-carotene or mixtures thereof also encompass the corresponding salts, such as, for example, tryptophane hydrochloride, arginine hydrochloride, phenylalanine hydrochloride, tyrosine hydrochloride, threonine hydrochloride, valine hydrochloride, isoleucine hydrochloride or leucine hydrochloride or tryptophane sulfate, arginine sulfate, phenylalanine sulfate, tyrosine sulfate, threonine sulfate, valine sulfate, isoleucine sulfate or leucine sulfate; ester or amids.

Owing to the biological activity of the proteins which are used in the process according to the invention and which are encoded by nucleic acid molecules according to the invention, it is possible to produce compositions comprising the fine chemical, i.e. an increased amount of the free chemical free or bound, e.g amino acid compositions. Depending on the choice of the organism used for the process according to the present invention, for example a microorganism or a plant, compositions or mixtures of various fine chemicals e.g. amino acids can be produced.

The term "expression" refers to the transcription and/or translation of a codogenic gene segment or gene. As a rule, the resulting product is an mRNA or a protein. However, expression products can also include functional RNAs such as, for example, antisense, nucleic acids, tRNAs, snRNAs, rRNAs, RNAi, siRNA, ribozymes etc. Expression may be systemic, local or temporal, for example limited to certain cell types, tissues organs or time periods.

In one embodiment, the process of the present invention comprises one or more of the following steps:
a) stabilizing a protein conferring the increased expression of a protein encoded by the nucleic acid molecule of the invention or of the protein of the invention, e.g. of a protein having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or its homologs having the fine chemical increasing activity;

b) stabilizing a mRNA conferring the increased expression of a protein encoded by the nucleic acid molecule of the invention, e.g. of a protein having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or its homologs or of an mRNA encoding the polypeptide of the present invention having the fine chemical increasing activity;

c) increasing the specific activity of a protein conferring the increased expression of a protein encoded by the nucleic acid molecule of the invention or of the protein of the invention having the fine chemical increasing activity, e.g. of a protein having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or its homologs, or decreasing the inhibitiory regulation of the protein of the invention;

d) generating or increasing the expression of an endogenous or artificial transcription factor mediating the expression of a protein conferring the increased expression of a protein encoded by the nucleic acid molecule of the invention or of the protein of the invention having the fine chemical increasing activity, e.g. of a polypeptide having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or its homologs;

e) stimulating activity of a protein conferring the increased expression of a protein encoded by the nucleic acid molecule of the present invention or a protein of the present invention having the fine chemical increasing activity, e.g. of a protein having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or its homologs, by adding one or more exogenous inducing factors to the organismus or parts thereof;

f) expressing a transgenic gene encoding a protein conferring the increased expression of a polypeptide (=protein) encoded by the nucleic acid molecule or the protein of the invention, having the fine chemical increasing activity, e.g. of a protein having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or its homologs;

g) increasing the copy number of a gene conferring the increased expression of a nucleic acid molecule encoding a protein encoded by the nucleic acid molecule of the invention or the protein of the invention the fine chemical increasing activity, e.g. of a protein having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or its homologs;

h) increasing the expression of the endogenous gene encoding the protein of the invention, e.g. a protein having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or its homologs, by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to acitivty of positive elements. Positive elements can be randomly introduced in plants by T-DNA or transposon mutagenesis and lines can be identified in which the positive elements have be integrated near to a gene of the invention, the expression of which is thereby enhanced;

i) modulating growth conditions of an organism in such a manner, that the expression or activity of the gene encoding the protein of the invention or the protein itself is enhanced for example microorganisms or plants can be grown under a higher temperature regime leading to an enhanced expression of heat shock proteins, e.g. the heat shock protein of the invention, which can lead an enhanced the fine chemical production; and/or j) selecting of organisms with expecially high activity of the protein of the invention from natural or from mutagenized resources and breeding them into the target organisms, eg the elite crops.

Preferably, said mRNA is the nucleic acid molecule of the invention and/or the protein conferring the increased expression of a protein encoded by the nucleic acid molecule of the invention or the polypeptide having the herein mentioned activity, e.g. conferring the increase of the fine chemical after increasing the expression or activity of the encoded polypeptide or having the activity of a polypeptide having biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or its homologs.

In general, the amount of mRNA, polynucleotide or nucleic acid molecule in a cell or a compartment of an organism correlates with the amount of encoded protein and thus with the overall activity of the encoded protein in said volume. Said correlation is not always linear, the activity in the volume is dependent on the stability of the molecules, the degradation of the molecules or the presence of activating or inhibiting co-factors. Further, product and educt inhibitions of enzymes are well known and described in textbooks, e.g. Stryer, Biochemistry or Zinser et al. "Enzyminhibitoren"/Enzyme inhibitors".

The activity of the abovementioned proteins and/or polypeptide encoded by the nucleic acid molecule of the present invention can be increased in various ways. For example, the activity in an organism or in a part thereof, like a cell, is increased via increasing the gene product number, e.g. by increasing the expression rate, like introducing a stronger promoter, or by increasing the stability of the mRNA expressed, thus increasing the translation rate, and/or increasing the stability of the gene product, thus reducing the proteins decayed. Further, the activity or turnover of enzymes can be influenced in such a way that a reduction or increase of the reaction rate or a modification (reduction or increase) of the affinity to the substrate results, is reached. A mutation in the catalytic centre of a polypeptide of the invention, e.g. an enzyme, can modulate the turn over rate of the enzyme, e.g. a knock out of an essential amino acid can lead to a reduced or completely knock out activity of the enzyme, or the deletion or mutation of regulator binding sites can reduce a negative regulation like a feedback inhibition (or a substrate inhibition, if the substrate level is also increased). The specific activity of an enzyme of the present invention can be increased such that the turn over rate is increased or the binding of a co-factor is improved. Improving the stability of the encoding mRNA or the protein can also increase the activity of a gene product. The stimulation of the activity is also under the scope of the term "increased activity".

Moreover, the regulation of the abovementioned nucleic acid sequences may be modified so that gene expression is increased. This can be achieved advantageously by means of heterologous regulatory sequences or by modifying, for example mutating, the natural regulatory sequences which are present. The advantageous methods may also be combined with each other.

In general, an activity of a gene product in an organism or part thereof, in particular in a plant cell, a plant, or a plant tissue or a part thereof or in a microorganism can be increased by increasing the amount of the specific encoding mRNA or the corresponding protein in said organism or part thereof. "Amount of protein or mRNA" is understood as meaning the molecule number of polypeptides or mRNA molecules in an organism, a tissue, a cell or a cell compartment. "Increase" in the amount of a protein means the quantitative increase of the molecule number of said protein in an organism, a tissue, a cell or a cell compartment or part thereof—for example by one of the methods described herein below—in comparison to a wild type, control or reference.

The increase in molecule number amounts preferably to at least 1%, preferably to more than 10%, more preferably to 30% or more, especially preferably to 50%, 70% or more, very especially preferably to 100%, most preferably to 500% or more. However, a de novo expression is also regarded as subject of the present invention.

A modification, i.e. an increase or decrease, can be caused by endogenous or exogenous factors. For example, an increase in activity in an organism or a part thereof can be caused by adding a gene product or a precursor or an activator or an agonist to the media or nutrition or can be caused by introducing said subjects into a organism, transient or stable.

In one embodiment the increase in the amount of the fine chemical in the organism or a part thereof, e.g. in a cell, a tissue, an organ, an organelle etc., is achived by increasing the endogenous level of the polypeptide of the invention. Accordingly, in an embodiment of the present invention, the present invention relates to a process wherein the gene copy number of a gene encoding the polynucleotide or nucleic acid molecule of the invention is increased. Further, the endogenous level of the polypeptide of the invention can for example be increased by modifiying the transcriptional or translational regulation of the polypeptide.

In one embodiment the amount of the fine chemical in the organism or part thereof can be increase by targeted or random mutagenesis of the endogenous genes of the invention. For example homologous recombination can be used to either introduce positive regulatory elements like for plants the 35S enhancer into the promoter or to remove repressor elements form regulatory regions. In addition gene conversion like methods described by Kochevenko and Willmitzer (Plant Physiol. 2003 May; 132(1): 174-84) and citations therein can be used to disrupt repressor elements or to enhance to acitivty of positive regulatory elements.

Furthermore positive elements can be randomly introduced in (plant) genomes by T-DNA or transposon mutagenesis and lines can be screened for, in which the positive elements has be integrated near to a gene of the invention, the expression of which is thereby enhanced. The activation of plant genes by random integrations of enhancer elements has been described by Hayashi et al., 1992 (Science 258:1350-1353) or Weigel et al., 2000 (Plant Physiol. 122, 1003-1013) and others cited therein. Reverse genetic strategies to identify insertions (which eventually carrying the activation elements) near in genes of interest have been described for various cases eg. Krysan et al., 1999 (Plant Cell 1999, 11, 2283-2290); Sessions et al., 2002 (Plant Cell 2002, 14, 2985-2994); Young et al., 2001, (Plant Physiol. 2001, 125, 513-518); Koprek et al., 2000 (Plant J. 2000, 24, 253-263); Jeon et al., 2000 (Plant J. 2000, 22, 561-570); Tissier et al., 1999 (Plant Cell 1999, 11, 1841-1852); Speulmann et al., 1999 (Plant Cell 1999, 11, 1853-1866). Briefly material from all plants of a large T-DNA or transposon mutagenized plant population is harvested and genomic DNA prepared. Then the genomic DNA is pooled following specific architectures as described for example in Krysan et al., 1999 (Plant Cell 1999, 11, 2283-2290). Pools of genomics DNAs are then screened by specific multiplex PCR reactions detecting the combination of the insertional mutagen (eg T-DNA or Transposon) and the gene of interest. Therefore PCR reactions are run on the DNA pools with specific combinations of T-DNA or transposon border primers and gene specific primers. General rules for primer design can again be taken from Krysan et al., 1999 (Plant Cell 1999, 11, 2283-2290) Rescreening of lower levels DNA pools lead to the identifcation of individual plants in which the gene of interest is disrupted by the insertional mutagen.

The enhancement of positive regulatory elements or the disruption or weaking of negative regulatory elements can also be achieved through common mutagenesis techniques: The production of chemically or radiation mutated populations is a common technique and known to the skilled worker. Methods for plants are described by Koorneef et al. 1982 and the citations therein and by Lightner and Caspar in "Methods in Molecular Biology" Vol 82. These techniques usually induce point mutations that can be identified in any known gene using methods such as TILLING (Colbert et al. 2001).

Accordingly, the expression level can be increased if the endogenous genes encoding a polypeptide conferring an increased expression of the polypeptide of the present invention, in particular genes comprising the nucleic acid molecule of the present invention, are modified via homologous recombination, Tilling approaches or gene conversion Regulatory sequences can be operatively linked to the coding region of an endogenous protein and control its transcription and translation or the stability or decay of the encoding mRNA or the expressed protein. In order to modify and control the expression, promoter, UTRs, splicing sites, processing signals, polyadenylation sites, terminators, enhancers, repressors, post transcriptional or posttranslational modification sites can be changed, added or amended for example, the activation of plant genes by random integrations of enhancer elements has been described by Hayashi et al., 1992 (Science 258:1350-1353) or Weigel et al., 2000 (Plant Physiol. 122, 1003-1013) and others cited therein. For example, the expression level of the endogenous protein can be modulated by replacing the endogenous promoter with a stronger transgenic promoter or by replacing the endogenous 3'UTR with a 3'UTR, which provides more stablitiy without amending the coding region. Further, the transcriptional regulation can be modulated by introduction of an artifical transcription factor as described in the examples. Alternative promoters, terminators and UTR are described below.

The activation of an endogenous polypeptide having the fine chemical increasing activity, e.g. having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394, e.g. conferring the increase of the fine chemical after increase of expression or activity can also be increased by introducing a synthetic transcription factor, which binds close to the coding region of the protein of the invention encoding gene and activates its transcription. A chimeric zinc finger protein can be construed, which comprises a specific DNA-binding domain and an activation domain as e.g. the VP16 domain of Herpes Simplex virus. The specific binding domain can bind to the regulatory region of the nucleic acid sequence used in the inventive process. The expression of the chimeric transcription factor in an organism, in particular in a plant, leads to a specific expression of the protein of the invention, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

In one further embodiment of the process according to the invention, organisms are used in which one of the abovementioned genes, or one of the abovementioned nucleic acids, is mutated in a way that the activity of the encoded gene products is less influenced by cellular factors, or not at all, in comparison with the unmutated proteins. For example, well known regulation mechanism of enzymic activity are substrate inhibition or feed back regulation mechanisms. Ways and techniques for the introduction of substitutions, deletions and additions of one or more bases, nucleotides or amino acids of a corresponding sequence are described herein below in the corresponding paragraphs and the references listed there, e.g. in Sambrook et al., Molecular Cloning, Cold Spring Habour, N.Y., 1989. The person skilled in the art will be able to identify regulation domains and binding sites of regulators by comparing the sequence of the nucleic acid molecule of the present invention or the expression product thereof with the state of the art by computer software means which comprise algorithms for the identifying of binding sites and regulation domains or by introducing into a nucleic acid molecule or in a protein systematically mutations and assaying for those mutations which will lead to an increased specifiy activity or an increased activity per volume, in particular per cell.

It is therefore adavantageously to express in an organism a nucleic acid molecule of the invention or a polypeptide of the invention derived from a evolutionary distantly related organism, as e.g. using a prokaryotic gene in a eukaryotic host, as in these cases the regulation mechanism of the host cell may not weaken the activity (cellular or specific) of the gene or its expression product The mutation is introduced in such a way that the production of the fine chemical is not adversely affected.

Less influence on the regulation of a gene or its gene product is understood as meaning a reduced regulation of the enzymatic activity leading to an increased specific or cellular activity of the gene or its product. An increase of the enzymatic activity is understood as meaning an enzymatic activity, which is increased by at least 10%, 20%, 30%, 40% or 50%, advantageously by at least 60%, 70%, 80%, 90% or 100%, especially advantageously by at least 150%, 200%, 300% or more in comparison with the starting organism. In the event the inventive nucleic acid sequences were introduced into an organism, which did not have the encoded protein activity, said new generated enzymatic activity shall also be embraced by the herein described invention. This leads to an increased productivity of the desired fine chemical.

Owing to the introduction of a gene or a plurality of genes conferring the expression of the nucleic acid molecule of the invention or the polypeptide of the invention as described below, for example the nucleic acid construct mentioned below, or e.g. encoding the protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 into an organism alone or in combination with other genes, it is possible not only to increase the biosynthetic flux towards the end product, but also to increase, modify or create de novo an advantageous, preferably novel metabolites composition in the organism, e.g. an advantageous amino acid composition comprising a higher content of (from a viewpoint of nutrional physiology limited) amino acids, for example essential amino acids like tryptophane, threonine, methionine or lysine.

Preferably the composition comprises further higher amounts of metabolites positively affecting or lower amounts of metabolites negatively affecting the nutrition or health of animals or humans provided with said compositions or organisms of the invention or parts thereof. Likewise, the number or activity of further genes which are required for the import or export of nutrients or metabolites, including for example amino acids or its precursors, required for the cell's biosynthesis of the fine chemical may be increased so that the concentration of necessary or relevant precursors, cofactors or intermediates within the cell(s) or within the corresponding storage compartments is increased. Owing to the increased or novel generated activity of the polypeptide of the invention or owing to the increased number of nucleic acid sequences of the invention and/or to the modulation of further genes which are involved in the biosynthesis of the fine chemical, e.g. by increasing the acitivty of enzymes synthizing precursors or by destroying the activity of one or more genes which are involved in the breakdown of the fine chemical, it is thereby possible to increase the yield, production and/or production efficiency of the fine chemical in the host organism, such as plants or microorganims.

Accordingly, in one embodiment, the process according to the invention relates to a process, which comprises:

a) providing a non-human organism, preferably a microorganism, non-human animal, plant or part, cell or tissue thereof;

b) increasing the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or of a polypeptide being encoded by the nucleic acid molecule of the invention and described below, i.e. conferring an increase of the fine chemical in the organism, preferably in the microorganism, the non-human animal, the plant or part, cell or tissue thereof, c) growing the organism, preferably the microorganism, the non-human animal, the plant or part, cell or tissue thereof under conditions which permit the production of the fine chemical; and d) if desired, revovering, optionally isolating, the free and/or bound fine chemical.

The organism, in particular the microorganism, non-human animal, the plant or animal parts, the plant or animal cell, the plant or animal tissue or the plant is advantageously grown in such a way that it is not only possible to recover, if desired isolate the free or bound fine chemical (Galili et al., Transgenic Res., 2000, 9, 2, 137-144).

After the above-described increasing (which as defined above also encompasses the generating of an activity in an organism, i.e. a de novo activity), for example after the introduction and the expression of the nucleic acid molecules of the invention or described in the methods or processes according to the invention, the organism according to the invention, advantageously, a microorganism, a non-human animal, a plant, plant or animal tissue or plant or animal cell, is grown and subsequently harvested.

Suitable organisms or host organisms (transgenic organism) for the nucleic acid molecule used according to the invention and for the inventive process, the nucleic acid construct or the vector (both as described below) are, in principle, all organisms which are capable of synthesizing the fine chemical, and which are suitable for the activation, introduction or stimulation genes. Examples which may be mentioned are plants, microorganisms such as fungi, bacteria, yeasts, alga or diatom, transgenic or obtained by site directed mutagenesis or random mutagenesis combined with specific selection procedures. Preferred organisms are those which are naturally capable of synthesizing the fine chemical in substantial amounts, like fungi, yeasts, bactria or plants. In principle, transgenic animals, for example *Caenorhabditis elegans*, are also suitable as host organisms.

In the event that the transgenic organism is a microorganism, such as a eukaryotic organism, for example a fungus, an alga, diatom or a yeast in particular a fungus, alga, diatom or yeast selected from the families Chaetomiaceae, Choanephoraceae, Cryptococcaceae, Cunninghamellaceae, Demetiaceae, Dipodascaceae, Moniliaceae, Mortierellaceae, Mucoraceae, Pythiaceae, Saccharomycetaceae, Saprolegniaceae, Schizosaccharomycetaceae, Sodariaceae, Sporobolomycetaceae Tuberculariaceae, Adelotheciaceae, Dinophyceae, Ditrichaceae or Prasinophyceae, or a fungus selected from the families Tremellaceae, Filobasidiaceae, Christianseniaceae, Cystofilobasidiaceae, Sordariaceae, Annulatascaceae, Cephalothecaceae, Chaetomiaceae, Coniochaetaceae, Lasiosphaeriaceae, Pleurotremataceae, Elaphomycetaceae, Trichocomaceae, Mucoraceae, Schizophyllaceae, Onygenaceae, Suillaceae, Hypocreaceae, Ustilaginaceae, Trichocomaceae, Phyllachoraceae, Erysiphaceae or a prokaryotic organism, for example a bacterium or blue alga, in particular a bacterium from the families Actinomycetaceae, Bacillaceae, Brevibacteriaceae, Corynebacteriaceae, Cyanophyceae, Enterobacteriacae, Gordoniaceae, Nocardiaceae, Micrococcaceae, Mycobacteriaceae, Pseudomonaceae, Rhizobiaceae or Streptomycetaceae, this microorganism is grown on a solid or in a liquid medium which is known to the skilled worker and suits the organism. After the growing phase, the organisms can be harvested.

The microorganisms or the recovered, and if desired isolated, fine chemical can then be processed further directly into foodstuffs or animal feeds or for other applications, for example according to the disclosures made in EP-B-0 533 039 or EP-A-0 615 693, which are expressly incorporated herein by reference. The fermentation broth or fermentation products can be purified in the customary manner by extraction and precipitation or via ion exchangers and other methods known to the person skilled in the art and described herein below. Products of these different work-up procedures are fine chemical e.g. amino acids or amino acid compositions which still comprise fermentation broth and cell components in different amounts, advantageously in the range of from 0 to 99% by weight, preferably below 80% by weight, especially preferably between below 50%, 40%, 30%, 20%, 10% or 5% by weight.

Preferred microorganisms are selected from the group consisting of Chaetomiaceae such as the genera *Chaetomium* e.g. the species *Chaetomidium fimeti*; Choanephoraceae such as the genera *Blakeslea*, *Choanephora* e.g. the species *Blakeslea trispora*, *Choanephora cucurbitarum* or *Choanephora infundibulifera* var. *cucurbitarum*; Cryptococcaceae such as the genera *Candida*, *Crytococcus*, *Rhodotorula*, *Torulopsis* e.g. the species *Candida albicans*, *Candida albomarginata*, *Candida antarctica*, *Candida bacarum*, *Candida bogoriensis*, *Candida boidinii*, *Candida bovina*, *Candida brumptii*, *Candida cacaoi*, *Candida cariosilignicola*, *Candida catenulata*, *Candida chalmersii*, *Candida ciferrii*, *Candida cylindracea*, *Candida edax*, *Candida ernobii*, *Candida famata*, *Candida freyschussii*, *Candida friedrichii*, *Candida glabrata*, *Candida guilliermondii*, *Candida haemulonii*, *Candida humicola*, *Candida inconspicua*, *Candida ingens*, *Candida intermedia*, *Candida kefyr*, *Candida krusei*, *Candida lactiscondensi*, *Candida lambica*, *Candida lipolytica*, *Candida lusitaniae*, *Candida macedoniensis*, *Candida magnoliae*, *Candida membranaefaciens*, *Candida mesenterica*, *Candida multigemmis*, *Candida mycoderma*, *Candida nemodendra*, *Candida nitratophila*, *Candida norvegensis*, *Candida norvegica*, *Candida parapsilosis*, *Candida pelliculosa*, *Candida peltata*, *Candida pini*, *Candida pseudotropicalis*, *Candida pulcherrima*, *Candida punicea*, *Candida pustula*, *Candida ravautii*, *Candida reukaufii*, *Candida rugosa*, *Candida sake*, *Candida silvicola*, *Candida solani*, *Candida* sp., *Candida spandovensis*, *Candida succiphila*, *Candida tropicalis*, *Candida utilis*, *Candida valida*, *Candida versatilis*, *Candida vini*, *Candida zeylanoides*, *Cryptococcus albidus*, *Cryptococcus curvatus*, *Cryptococcus flavus*, *Cryptococcus humicola*, *Cryptococcus hungaricus*, *Cryptococcus kuetzingii*, *Cryptococcus laurentii*, *Cryptococcus macerans*, *Cryptococcus neoformans*, *Cryptococcus terreus*, *Cryptococcus uniguttulatus*, *Rhodotorula acheniorum*, *Rhodotorula bacarum*, *Rhodotorula bogoriensis*, *Rhodotorula flava*, *Rhodotorula glutinis*, *Rhodotorula macerans*, *Rhodotorula minuta*, *Rhodotorula mucilaginosa*, *Rhodotorula pilimanae*, *Rhodotorula pustula*, *Rhodotorula rubra*, *Rhodotorula tokyoensis*, *Torulopsis colliculosa*, *Torulopsis dattila* or *Torulopsis neoformans*; such as the genera *Cunninghamella* e.g. the species *Cunninghamella blakesleeana*, *Cunninghamella echinulata*, *Cunninghamella echinulata* var. *elegans*, *Cunninghamella elegans* or *Cunninghamella homothallica*; Demetiaceae such as the genera *Alternaria*, *Bipolaris*, *Cercospora*, *Chalara*, *Cladosporium*, *Curvularia*, *Exophilia*, *Helicosporium*, *Helminthosporium*, *Orbimyces*, *Philalophora*, *Pithomyces*, *Spilocaea*, *Thielaviopsis*, *Wangiella* e.g. the species *Curvularia affinis*, *Curvularia clavata*, *Curvularia fallax*, *Curvularia inaequalis*, *Curvularia indica*, *Curvularia lunata*, *Curvularia pallescens*, *Curvularia verruculosa* or *Helminothosporium* sp.; Moniliaceae such as the genera *Arthrobotrys*, *Aspergillus*, *Epidermophyton*, *Geotrichum*, *Gliocladium*, *Histoplasma*, *Microsporum*, *Monilia*, *Oedocephalum*, *Oidium*, *Penicillium*, *Trichoderma*, *Trichophyton*, *Thrichoteclum*, *Verticillium* e.g. the species *Aspergillus aculeatus*, *Aspergillus albus*, *Aspergillus alliaceus*, *Aspergillus asperescens*, *Aspergillus awamori*, *Aspergillus candidus*, *Aspergillus carbonarius*, *Aspergillus carneus*, *Aspergillus chevalieri*, *Aspergillus chevalieri* var. *intermedius*, *Aspergillus clavatus*, *Aspergillus ficuum*, *Aspergillus flavipes*, *Aspergillus flavus*, *Aspergillus foetidus*, *Aspergillus fumigatus*, *Aspergillus giganteus*, *Aspergillus humicola*, *Aspergillus intermedius*, *Aspergillus japonicus*, *Aspergillus nidulans*, *Aspergillus niger*, *Aspergillus niveus*, *Aspergillus ochraceus*, *Aspergillus oryzae*, *Aspergillus ostianus*, *Aspergillus parasiticus*, *Aspergillus parasiticus* var. *globosus*, *Aspergillus penicillioides*, *Aspergillus phoenicis*, *Aspergillus rugulosus*, *Aspergillus sclerotiorum*, *Aspergillus sojae* var. *gymnosardae*, *Aspergillus sydowi*, *Aspergillus tamarai*, *Aspergillus terreus*, *Aspergillus terricola*, *Aspergil-* lus toxicarius, Aspergillus unguis, Aspergillus ustus, Aspergillus versicolor, Aspergillus vitricolae, Aspergillus wentii, •Penicillium adametzi, •Penicillium albicans, Penicillium arabicum, Penicillium arenicola, Penicillium argillaceum, Penicillium arvense, Penicillium asperosporum, •Penicillium aurantiogriseum, •Penicillium avellaneum, •Penicillium baarnense, •Penicillium bacillisporum, •Penicillium brasilianum, •Penicillium brevicompactum, •Penicillium camemberti, •Penicillium canadense, •Penicillium canescens, •Penicillium caperatum, •Penicillium capsulatum, •Penicillium caseicolum, •Penicillium chrysogenum, •Penicillium citreonigrum, •Penicillium citrinum, •Penicillium claviforme, •Penicillium commune, •Penicillium corylophilum, •Penicillium corymbiferum, •Penicillium crustosum, •Penicillium cyclopium, •Penicillium daleae, •Penicillium decumbens, •Penicillium dierckxii, •Penicillium digitatum, •Penicillium digitatum var. latum, •Penicillium divaricatum, •Penicillium diversum, •Penicillium duclauxii, •Penicillium echinosporum, •Penicillium expansum, •Penicillium fellutanum, •Penicillium frequentans, •Penicillium funiculosum, •Penicillium glabrum, •Penicillium gladioli, •Penicillium griseofulvum, •Penicillium hirsutum, •Penicillium hispanicum, •Penicillium islandicum, •Penicillium italicum, •Penicillium italicum var. avellaneum, •Penicillium janczewskii, •Penicillium janthinellum, •Penicillium japonicum, •Penicillium lavendulum, •Penicillium lilacinum, •Penicillium lividum, •Penicillium martensii, Penicillium megasporum, •Penicillium miczynskii, •Penicillium nalgiovense, •Penicillium nigricans, Penicillium notatum, •Penicillium ochrochloron, •Penicillium odoratum, •Penicillium oxalicum, •Penicillium paraherquei, •Penicillium patulum, •Penicillium pinophilum, •Penicillium piscarium, •Penicillium pseudostromaticum, •Penicillium puberulum, •Penicillium purpurogenum, •Penicillium raciborskii, •Penicillium roqueforti, •Penicillium rotundum, •Penicillium rubrum, •Penicillium sacculum, •Penicillium simplicissimum, Penicillium sp., Penicillium spinulosum, Penicillium steckii, Penicillium stoloniferum, Penicillium striatisporum, Penicillium striatum, Penicillium tardum, Penicillium thomii, Penicillium turbatum, Penicillium variabile, Penicillium vermiculatum, Penicillium vermoesenii, Penicillium verrucosum, Penicillium verrucosum var. corymbiferum, Penicillium verrucosum var. cyclopium, Penicillium verruculosum, Penicillium vinaceum, Penicillium violaceum, Penicillium viridicatum, Penicillium vulpinum, Trichoderma hamatum, Trichoderma harzianum, Trichoderma koningii, Trichoderma longibrachiatum, Trichoderma polysporum, Trichoderma reesei, Trichoderma virens or Trichoderma viride; Mortierellaceae such as the genera Mortierella e.g. the species Mortierella isabellina, Mortierella polycephala, Mortierella ramanniana, Mortierella vinacea or Mortierella zonata; Mucoraceae such as the genera Actinomucor, Mucor, Phycomyces, Rhizopus, Zygorhynchus e.g. the species Mucor amphibiorum, Mucor circinelloides f. circinelloides, Mucor circinelloides var. griseocyanus, Mucor flavus, Mucor fuscus, Mucor griseocyanus, Mucor heterosporus, Mucor hiemalis, Mucor hiemalis f. hiemalis, Mucor inaequisporus, Mucor indicus, Mucor javanicus, Mucor mucedo, Mucor mucilagineus, Mucor piriformis, Mucor plasmaticus, Mucor plumbeus, Mucor racemosus, Mucor racemosus f. racemosus, Mucor racemosus f. sphaerosporus, Mucor rouxianus, Mucor rouxii, Mucor sinensis, Mucor sp., Mucor spinosus, Mucor tuberculisporus, Mucor varlisporus, Mucor variosporus, Mucor wosnessenskii, Phycomyces blakesleeanus, Rhizopus achlamydosporus, Rhizopus arrhizus, Rhizopus chinensis, Rhizopus delemar, Rhizopus formosaensis, Rhizopus japonicus, Rhizopus javanicus, Rhizopus microsporus, Rhizopus microsporus var. chinensis, Rhizopus microsporus var. oligosporus, Rhizopus microsporus var. rhizopodiformis, Rhizopus nigricans, Rhizopus niveus, Rhizopus oligosporus, Rhizopus oryzae, Rhizopus pygmaeus, Rhizopus rhizopodiformis, Rhizopus semarangensis, Rhizopus sontii, Rhizopus stolonifer, Rhizopus thermosus, Rhizopus tonkinensis, Rhizopus tritici or Rhizopus usamii; Pythiaceae such as the genera Phytium, Phytophthora e.g. the species Pythium debaryanum, Pythium intermedium, Pythium irregulare, Pythium megalacanthum, Pythium paroecandrum, Pythium sylvaticum, Pythium ultimum, Phytophthora cactorum, Phytophthora cinnamomi, Phytophthora citricola, Phytophthora citrophthora, Phytophthora cryptogea, Phytophthora drechsleri, Phytophthora erythroseptica, Phytophthora lateralis, Phytophthora megasperma, Phytophthora nicotianae, Phytophthora nicotianae var. parasitica, Phytophthora palmivora, Phytophthora parasitica or Phytophthora syringae; Saccharomycetaceae such as the genera Hansenula, Pichia, Saccharomyces, Saccharomycodes, Yarrowia e.g. the species Hansenula anomala, Hansenula californica, Hansenula canadensis, Hansenula capsulata, Hansenula ciferrii, Hansenula glucozyma, Hansenula henricii, Hansenula holstii, Hansenula minuta, Hansenula nonfermentans, Hansenula philodendri, Hansenula polymorpha, Hansenula saturnus, Hansenula subpelliculosa, Hansenula wickerhamii, Hansenula wingei, Pichia alcoholophila, Pichia angusta, Pichia anomala, Pichia bispora, Pichia burtonii, Pichia canadensis, Pichia capsulata, Pichia carsonii, Pichia cellobiosa, Pichia ciferrii, Pichia farinosa, Pichia fermentans, Pichia finlandica, Pichia glucozyma, Pichia guilliermondii, Pichia haplophila, Pichia henricii, Pichia holstii, Pichia jadinii, Pichia lindnerii, Pichia membranaefaciens, Pichia methanolica, Pichia minuta var. minuta, Pichia minuta var. nonfermentans, Pichia norvegensis, Pichia ohmeri, Pichia pastoris, Pichia philodendri, Pichia pini, Pichia polymorpha, Pichia quercuum, Pichia rhodanensis, Pichia sargentensis, Pichia stipitis, Pichia strasburgensis, Pichia subpelliculosa, Pichia toletana, Pichia trehalophila, Pichia vini, Pichia xylosa, Saccharomyces aceti, Saccharomyces bailii, Saccharomyces bayanus, Saccharomyces bisporus, Saccharomyces capensis, Saccharomyces carisbergensis, Saccharomyces cerevisiae, Saccharomyces cerevisiae var. ellipsoideus, Saccharomyces chevalieri, Saccharomyces delbrueckii, Saccharomyces diastaticus, Saccharomyces drosophilarum, Saccharomyces elegans, Saccharomyces ellipsoideus, Saccharomyces fermentati, Saccharomyces florentinus, Saccharomyces fragilis, Saccharomyces heterogenicus, Saccharomyces hienipiensis, Saccharomyces inusitatus, Saccharomyces italicus, Saccharomyces kluyveri, Saccharomyces krusei, Saccharomyces lactis, Saccharomyces marxianus, Saccharomyces microellipsoides, Saccharomyces montanus, Saccharomyces norbensis, Saccharomyces oleaceus, Saccharomyces paradoxus, Saccharomyces pastorianus, Saccharomyces pretoriensis, Saccharomyces rosei, Saccharomyces rouxii, Saccharomyces uvarum, Saccharomycodes ludwigii or Yarrowia lipolytica; Saprolegniaceae such as the genera Saprolegnia e.g. the species Saprolegnia ferax; Schizosaccharomycetaceae such as the genera Schizosaccharomyces e.g. the species Schizosaccharomyces japonicus var. japonicus, Schizosaccharomyces japonicus var. versatilis, Schizosaccharomyces malidevorans, Schizosaccharomyces octosporus, Schizosaccharomyces pombe var. malidevorans or Schizosaccharomyces pombe var. pombe; Sodariaceae such as the genera Neurospora, Sordaria e.g. the species Neurospora africana, Neurospora crassa, Neurospora intermedia, Neurospora sitophila, Neurospora tetrasperma, Sordaria fimicola or Sordaria macrospora; Tuberculariaceae such as the genera

*Epicoccum, Fusarium, Myrothecium, Sphacelia, Starkeyomyces, Tubercularia* e.g. the species *Fusarium acuminatum, Fusarium anthophilum, Fusarium aquaeductuum, Fusarium aquaeductuum* var. *medium, Fusarium avenaceum, Fusarium buharicum, Fusarium camptoceras, Fusarium cerealis, Fusanum chlamydosporum, Fusarium ciliatum, Fusarium coccophilum, Fusarium coeruleum, Fusarium concolor, Fusarium crookwellense, Fusarium culmorum, Fusarium dimerum, Fusarium diversisporum, Fusarium equiseti, Fusanum equiseti* var. *bullatum, Fusarium eumartii, Fusarium flocciferum, Fusarium fujikuroi, Fusarium graminearum, Fusarium graminum, Fusarium heterosporum, Fusarium incarnatum, Fusarium inflexum, Fusarium javanicum, Fusarium lateritium, Fusarium lateritium* var. *majus, Fusarium longipes, Fusarium melanochlorum, Fusarium merismoides, Fusarium merismoides* var. *chlamydosporale, Fusarium moniliforme, Fusarium moniliforme* var. *anthophilum, Fusarium moniliforme* var. *subglutinans, Fusarium nivale, Fusarium nivale* var. *majus, Fusarium oxysporum, Fusarium oxysporum* f. sp. *aechmeae, Fusarium oxysporum* f. sp. *cepae, Fusarium oxysporum* f. sp. *conglutinans, Fusarium oxysporum* f. sp. *cucumerinum, Fusarium oxysporum* f. sp. *cyclaminis, Fusarium oxysporum* f. sp. *dianthi, Fusarium oxysporum* f. sp. *lycopersici, Fusarium oxysporum* f. sp. *melonis, Fusarium oxysporum* f. sp. *passiflorae, Fusarium oxysporum* f. sp. *pisi, Fusarium oxysporum* f. sp. *tracheiphilum, Fusarium oxysporum* f. sp. *tuberosi, Fusarium oxysporum* f. sp. *tulipae, Fusarium oxysporum* f. sp. *vasinfectum, Fusarium pallidoroseum, Fusarium poae, Fusarium proliferatum, Fusarium proliferatum* var. *minus, Fusarium redolens, Fusarium redolens* f. sp. *dianthi, Fusarium reticulatum, Fusarium roseum, Fusarium sacchari* var. *elongatum, Fusarium sambucinum, Fusarium sambucinum* var. *coeruleum, Fusarium semitectum, Fusarium semitectum* var. *majus, Fusarium solani, Fusarium solani* f. sp. *pisi, Fusarium sporotrichioides, Fusarium sporotrichioides* var. *minus, Fusarium sublunatum, Fusarium succisae, Fusarium sulphureum, Fusarium tabacinum, Fusarium tricinctum, Fusarium udum, Fusarium ventricosum, Fusarium verticillioides, Fusarium xylarioides* or *Fusarium zonatum*; Sporobolomycetaceae such as the genera *Bullera, Sporobolomyces, Itersonilia* e.g. the species *Sporobolomyces holsaticus, Sporobolomyces odorus, Sporobolomyces puniceus, Sporobolomyces salmonicolor, Sporobolomyces singularis* or *Sporobolomyces tsugae*; Adelotheciaceae such as the genera e.g. the species *Physcomitrella patens*; Dinophyceae such as the genera *Crypthecodinium, Phaeodactylum* e.g. the species *Crypthecodinium cohnii* or *Phaeodactylum tricornutum*; Ditrichaceae such as the genera *Ceratodon, Pleuridium, Astomiopsis, Ditrichum, Philibertiella, Ceratodon, Distichium, Skottsbergia* e.g. the species *Ceratodon antarcticus, Ceratodon purpureus, Ceratodon purpureus* ssp. *convolutes* or *Ceratodon purpureus* ssp. *stenocarpus*; Prasinophyceae such as the genera *Nephroselmis, Prasinococcus, Scherffelia, Tetraselmis, Mantoniella, Ostreococcus* e.g. the species *Nephroselmis olivacea, Prasinococcus capsulatus, Scherffelia dubia, Tetraselmis chui, Tetraselmis suecica, Mantoniella squamata* or *Ostreococcus tauri*; Actinomycetaceae such as the genera *Actinomyces, Actinobaculum, Arcanobacterium, Mobiluncus* e.g. the species *Actinomyces bernardiae, Actinomyces bovis, Actinomyces bowdenii, Actinomyces canis, Actinomyces cardiffensis, Actinomyces catuli, Actinomyces coleocanis, Actinomyces denticolens, Actinomyces europaeus, Actinomyces funkei, Actinomyces georgiae, Actinomyces gerencseriae, Actinomyces hordeovulneris, Actinomyces howellii, Actinomyces humiferus, Actinomyces hyovaginalis, Actinomyces israelii Actinomyces marimammalium, Actinomyces meyeri, Actinomyces naeslundii, Actinomyces nasicola, Actinomyces neuii* subsp. *anitratus, Actinomyces neuii* subsp. *neuii, Actinomyces odontolyticus, Actinomyces oricola, Actinomyces pyogenes, Actinomyces radicidentis, Actinomyces radingae, Actinomyces slackii, Actinomyces suimastitidis, Actinomyces suis, Actinomyces turicensis, Actinomyces urogenitalis, Actinomyces vaccimaxillae, Actinomyces viscosus, Actinobaculum schaalii, Actinobaculum suis, Actinobaculum urinale, Arcanobacterium bernardiae, Arcanobacterium haemolyticum, Arcanobacterium hippocoleae, Arcanobacterium phocae, Arcanobacterium pluranimalium, Arcanobacterium pyogenes, Mobiluncus curtisii* subsp. *curtisii, Mobiluncus curtisii* subsp. *holmesii* or *Mobiluncus mulieris*; Bacillaceae such as the genera *Amphibacillus, Anoxybacillus, Bacillus, Exiguobacterium, Gracilibacillus, Holobacillus, Saccharococcus, Salibacillus, Virgibacillus* e.g. the species *Amphibacillus fermentum, Amphibacillus tropicus, Amphibacillus xylanus, Anoxybacillus flavithermus, Anoxybacillus gonensis, Anoxybacillus pushchinoensis, Bacillus acidocaldarius, Bacillus acidoterrestris, Bacillus aeolius, Bacillus agaradhaerens, Bacillus agri, Bacillus alcalophilus, Bacillus alginolyticus, Bacillus alvei, Bacillus amyloliquefaciens, Bacillus amylolyticus, Bacillus aneurinilyticus, Bacillus aquimaris, Bacillus arseniciselenatis, Bacillus atrophaeus, Bacillus azotofixans, Bacillus azotoformans, Bacillus badius, Bacillus barbaricus, Bacillus benzoevorans, Bacillus borstelensis, Bacillus brevis, Bacillus carboniphilus, Bacillus centrosporus, Bacillus cereus, Bacillus chitinolyticus, Bacillus chondroitinus, Bacillus choshinensis, Bacillus circulans, Bacillus clarkii, Bacillus clausii, Bacillus coagulans, Bacillus cohnii, Bacillus curdlanolyticus, Bacillus cycloheptanicus, Bacillus decolorationis, Bacillus dipsosauri, Bacillus edaphicus, Bacillus ehimensis, Bacillus endophyticus, Bacillus fastidiosus, Bacillus firmus, Bacillus flexus, Bacillus formosus, Bacillus fumarioli, Bacillus funiculus, Bacillus fusiformis, Bacillus sphaericus* subsp. *fusiformis, Bacillus galactophilus, Bacillus globisporus, Bacillus globisporus* subsp. *marinus, Bacillus glucanolyticus, Bacillus gordonae, Bacillus halmapalus, Bacillus haloalkaliphilus, Bacillus halodenitrificans, Bacillus halodurans, Bacillus halophilus, Bacillus horikoshii, Bacillus horti, Bacillus infernos, Bacillus insolitus, Bacillus jeotgali, Bacillus kaustophilus, Bacillus kobensis, Bacillus krulwichiae, Bacillus laevolacticus, Bacillus larvae, Bacillus laterosporus, Bacillus lautus, Bacillus lentimorbus, Bacillus lentus, Bacillus licheniformis, Bacillus luciferensis, Bacillus macerans, Bacillus macquarensis, Bacillus marinus, Bacillus marisflavi, Bacillus marismortui, Bacillus megaterium, Bacillus methanolicus, Bacillus migulanus, Bacillus mojavensis, Bacillus mucilaginosus, Bacillus mycoides, Bacillus naganoensis, Bacillus nealsonii, Bacillus neidei, Bacillus niacini, Bacillus okuhidensis, Bacillus oleronius, Bacillus pabuli, Bacillus pallidus, Bacillus pantothenticus, Bacillus parabrevis, Bacillus pasteurii, Bacillus peoriae, Bacillus polymyxa, Bacillus popilliae, Bacillus pseudalcaliphilus, Bacillus pseudofirmus, Bacillus pseudomycoides, Bacillus psychrodurans, Bacillus psychrophilus, Bacillus psychrosaccharolyticus, Bacillus psychrotolerans, Bacillus pulvifaciens, Bacillus pumilus, Bacillus pycnus, Bacillus reuszeri, Bacillus salexigens, Bacillus schlegelii, Bacillus selenitireducens, Bacillus silvestris, Bacillus simplex, Bacillus siralis, Bacillus smithii, Bacillus sonorensis, Bacillus sphaericus, Bacillus sporothermodurans, Bacillus stearothermophilus, Bacillus subterraneus, Bacillus subtilis* subsp. *spizizenii, Bacillus subtilis* subsp. *subtilis, Bacillus thermantarcticus, Bacillus thermoaerophilus, Bacillus thermoamylovorans, Bacillus thermoantarcti-* cus, *Bacillus thermocatenulatus, Bacillus thermocloacae, Bacillus thermodenitrificans, Bacillus thermoglucosidasius, Bacillus thermoleovorans, Bacillus thermoruber, Bacillus thermosphaericus, Bacillus thiaminolyticus, Bacillus thuringiensis, Bacillus tusciae, Bacillus validus, Bacillus vallismortis, Bacillus vedderi, Bacillus vulcani, Bacillus weihenstephanensis, Exiguobacterium acetylicum, Exiguobacterium antarcticum, Exiguobacterium aurantiacum, Exiguobacterium undae, Gracilibacillus dipsosauri, Gracilibacillus halotolerans, Halobacillus halophilus, Halobacillus karajensis, Halobacillus litoralis, Halobacillus salinus, Halobacillus trueperi, Saccharococcus caldoxylosilyticus, Saccharococcus thermophilus, Salibacillus marismortui, Salibacillus salexigens, Virgibacillus carmonensis, Virgibacillus marismortui, Virgibacillus necropolis, Virgibacillus pantothenticus, Virgibacillus picturae, Virgibacillus proomii or Virgibacillus salexigens*, Brevibacteriaceae such as the genera *Brevibacterium* e.g. the species *Brevibacterium acetylicum, Brevibacterium albidum, Brevibacterium ammoniagenes, Brevibacterium avium, Brevibacterium casei, Brevibacterium citreum, Brevibacterium divaricatum, Brevibacterium epidermidis, Brevibacterium fermentans, Brevibacterium frigoritolerans, Brevibacterium halotolerans, Brevibacterium imperiale, Brevibacterium incertum, Brevibacterium iodinum, Brevibacterium linens, Brevibacterium liquefaciens, Brevibacterium lutescens, Brevibacterium luteum, Brevibacterium lyticum, Brevibacterium mcbrellneri, Brevibacterium otitidis, Brevibacterium oxydans, Brevibacterium paucivorans, Brevibacterium protophormiae, Brevibacterium pusillum, Brevibacterium saperdae, Brevibacterium stationis, Brevibacterium testaceum or Brevibacterium vitaeruminis*; Corynebacteriaceae such as the genera *Corynebacterium* e.g. the species *Corynebacterium accolens, Corynebacterium afermentans* subsp. *afermentans, Corynebacterium afermentans* subsp. *lipophilum, Corynebacterium ammoniagenes, Corynebacterium amycolatum, Corynebacterium appendicis, Corynebacterium aquilae, Corynebacterium argentoratense, Corynebacterium atypicum, Corynebacterium aurimucosum, Corynebacterium auris, Corynebacterium auriscanis, Corynebacterium betae, Corynebacterium beticola, Corynebacterium bovis, Corynebacterium callunae, Corynebacterium camporealensis, Corynebacterium capitovis, Corynebacterium casei, Corynebacterium confusum, Corynebacterium coyleae, Corynebacterium cystitidis, Corynebacterium durum, Corynebacterium efficiens, Corynebacterium equi, Corynebacterium falsenii, Corynebacterium fascians, Corynebacterium felinum, Corynebacterium flaccumfaciens, Corynebacterium flavescens, Corynebacterium freneyi, Corynebacterium glaucum, Corynebacterium glucuronolyticum, Corynebacterium glutamicum, Corynebacterium hoagii, Corynebacterium ilicis, Corynebacterium imitans, Corynebacterium insidiosum, Corynebacterium iranicum, Corynebacterium jeikeium, Corynebacterium kroppenstedtii, Corynebacterium kutscheri, Corynebacterium lilium, Corynebacterium lipophiloflavum, Corynebacterium macginleyi, Corynebacterium mastitidis, Corynebacterium matruchotii, Corynebacterium michiganense, Corynebacterium michiganense* subsp. *tessellarius, Corynebacterium minutissimum, Corynebacterium mooreparkense, Corynebacterium mucifaciens, Corynebacterium mycetoides, Corynebacterium nebraskense, Corynebacterium oortii, Corynebacterium paurometabolum, Corynebacterium phocae, Corynebacterium pilosum, Corynebacterium poinsettiae, Corynebacterium propinquum, Corynebacterium pseudodiphtheriticum, Corynebacterium pseudotuberculosis, Corynebacterium pyogenes, Corynebacterium rathayi, Corynebacterium renale, Corynebacterium riegelii, Corynebacterium seminale, Corynebacterium sepedonicum, Corynebacterium simulans, Corynebacterium singulare, Corynebacterium sphenisci, Corynebacterium spheniscorum, Corynebacterium striatum, Corynebacterium suicordis, Corynebacterium sundsvallense, Corynebacterium terpenotabidum, Corynebacterium testudinoris, Corynebacterium thomssenii, Corynebacterium tritici, Corynebacterium ulcerans, Corynebacterium urealyticum, Corynebacterium variabile, Corynebacterium vitaeruminis* or *Corynebacterium xerosis*; Enterobacteriacae such as the genera *Alterococcus, Arsenophonus, Brenneria, Buchnera, Budvicia, Buttiauxella, Calymmatobacterium, Cedecea, Citrobacter, Edwardsiella, Enterobacter, Erwinia, Escherichia, Ewingelia, Hafnia, Klebsiella, Kluyvera, Leclercia, Leminorella, Moellerella, Morganella, Obesumbacterium, Pantoea, Pectobacterium, Photorhabdus, Plesiomonas, Pragia, Proteus, Providencia, Rahnella, Saccharobacter, Salmonella, Shigella, Serratia, Sodalis, Tatumella, Trabulsiella, Wigglesworthia, Xenorhabdus, Yersinia* and *Yokenella* e.g. the species *Arsenophonus nasoniae, Brenneria alni, Brenneria nigrifluens, Brenneria quercina, Brenneria rubrifaciens, Brenneria salicis, Budvicia aquatica, Buttiauxella agrestis, Buttiauxella brennerae, Buttiauxella ferragutiae, Buttiauxella gaviniae, Buttiauxella izardii, Buttiauxella noackiae, Buttiauxella warmboldiae, Cedecea davisae, Cedecea lapagei, Cedecea neteri, Citrobacter amalonaticus, Citrobacter diversus, Citrobacter freundii, Citrobacter genomospecies, Citrobacter gilleni, Citrobacter intermedium, Citrobacter koseri, Citrobacter murliniae, Citrobacter* sp., *Edwardsiella hoshinae, Edwardsiella ictaluri, Edwardsiella tarda, Erwinia alni, Erwinia amylovora, Erwinia ananatis, Erwinia aphidicola, Erwinia billingiae, Erwinia cacticida, Erwinia cancerogena, Erwinia carnegieana, Erwinia carotovora* subsp. *atroseptica, Erwinia carotovora* subsp. *betavasculorum, Erwinia carotovora* subsp. *odorifera, Erwinia carotovora* subsp. *wasabiae, Erwinia chrysanthemi, Erwinia cypripedii, Erwinia dissolvens, Erwinia herbicola, Erwinia mallotivora, Erwinia milletiae, Erwinia nigrifluens, Erwinia nimipressuralis, Erwinia persicina, Erwinia psidii, Erwinia pyrifoliae, Erwinia quercina, Erwinia rhapontici, Erwinia rubrifaciens, Erwinia salicis, Erwinia stewartii, Erwinia tracheiphila, Erwinia uredovora, Escherichia adecarboxylata, Escherichia anindolica, Escherichia aurescens, Escherichia blattae, Escherichia coli, Escherichia coli* var. *communior, Escherichia coli-mutabile, Escherichia fergusonii, Escherichia hermannii, Escherichia* sp., *Escherichia vulneris, Ewingella americana, Hafnia alvei, Klebsiella aerogenes, Klebsiella edwardsii* subsp. *atlantae, Klebsiella ornithinolytica, Klebsiella oxytoca, Klebsiella planticola, Klebsiella pneumoniae, Klebsiella pneumoniae* subsp. *pneumoniae, Klebsiella* sp., *Klebsiella terrigena, Klebsiella trevisanii, Kluyvera ascorbata, Kluyvera citrophila, Kluyvera cochleae, Kluyvera cryocrescens, Kluyvera georgiana, Kluyvera noncitrophila, Kluyvera* sp., *Leclercia adecarboxylata, Leminorella grimontii, Leminorella richardii, Moellerella wisconsensis, Morganella morganii, Morganella morganii* subsp. *morganii, Morganella morganii* subsp. *sibonli, Obesumbaterium proteus, Pantoea agglomerans, Pantoea ananatis, Pantoea citrea, Pantoea dispersa, Pantoea punctata, Pantoea stewartii* subsp. *stewartii, Pantoea terrea, Pectobacterium atrosepticum, Pectobacterium carotovorum* subsp. *atrosepticum, Pectobacterium carotovorum* subsp. *carotovorum, Pectobacterium chrysanthemi, Pectobacterium cypripedii, Photorhabdus asymbiotica, Photorhabdus luminescens, Photorhabdus luminescens* subsp. *akhurstii, Photorhabdus luminescens* subsp. *laumondii, Photorhabdus luminescens* subsp. *luminescens*, *Photorhabdus* sp., *Photorhabdus temperata*, *Plesiomonas shigelloides*, *Pragia fontium*, *Proteus hauseri*, *Proteus ichthyosmius*, *Proteus inconstans*, *Proteus mirabilis*, *Proteus morganii*, *Proteus myxofaciens*, *Proteus penneri*, *Proteus rettgeri*, *Proteus shigelloides*, *Proteus vulgaris*, *Providencia alcalifaciens*, *Providencia friedericiana*, *Providencia heimbachae*, *Providencia rettgeri*, *Providencia rustigianii*, *Providencia stuartii*, *Rahnella aquatilis*, *Salmonella abony*, *Salmonella arizonae*, *Salmonella bongori*, *Salmonella choleraesuis* subsp. *arizonae*, *Salmonella choleraesuis* subsp. *bongori*, *Salmonella choleraesuis* subsp. *cholereasuis*, *Salmonella choleraesuis* subsp. *diarizonae*, *Salmonella choleraesuis* subsp. *houtenae*, *Salmonella choleraesuis* subsp. *indica*, *Salmonella choleraesuis* subsp. *salamae*, *Salmonella daressalaam*, *Salmonella enterica* subsp. *houtenae*, *Salmonella enterica* subsp. *salamae*, *Salmonella enteritidis*, *Salmonella gallinarum*, *Salmonella heidelberg*, *Salmonella panama*, *Salmonella senftenberg*, *Salmonella typhimurium*, *Serratia entomophila*, *Serratia ficaria*, *Serratia fonticola*, *Serratia grimesii*, *Serratia liquefaciens*, *Serratia marcescens*, *Serratia marcescens* subsp. *marcescens*, *Serratia madinorubra*, *Serratia odorifera*, *Serratia plymouthensis*, *Serratia plymuthica*, *Serratia proteamaculans*, *Serratia proteamaculans* subsp. *quinovora*, *Serratia quinivorans*, *Serratia rubidaea*, *Shigella boydii*, *Shigella flexneri*, *Shigella paradysenteriae*, *Shigella sonnei*, *Tatumella ptyseos*, *Xenorhabdus beddingii*, *Xenorhabdus bovienii*, *Xenorhabdus luminescens*, *Xenorhabdus nematophila*, *Xenorhabdus nematophila* subsp. *beddingii*, *Xenorhabdus nematophila* subsp. *bovienii*, *Xenorhabdus nematophila* subsp. *poinardi* or *Xenorhabdus poinarii*; Gordoniaceae such as the genera *Gordonia*, *Skermania* e.g. the species *Gordonia aichiensis*, *Gordonia alkanivorans*, *Gordonia amarae*, *Gordonia amicalis*, *Gordonia bronchialis*, *Gordonia desulfuricans*, *Gordonia hirsuta*, *Gordonia hydrophobica*, *Gordonia namibiensis*, *Gordonia nitida*, *Gordonia paraffinivorans*, *Gordonia polyisoprenivorans*, *Gordonia rhizosphera*, *Gordonia rubripertincta*, *Gordonia sihwensis*, *Gordonia sinesedis*, *Gordonia sputi*, *Gordonia terrae* or *Gordonia westfalica*; Micrococcaceae such as the genera *Micrococcus*, *Arthrobacter*, *Kocuria*, *Nesterenkonia*, *Renibacterium*, *Rothia*, *Stomatococcus* e.g. the species *Micrococcus agilis*, *Micrococcus antarcticus*, *Micrococcus halobius*, *Micrococcus kristinae*, *Micrococcus luteus*, *Micrococcus lylae*, *Micrococcus nishinomiyaensis*, *Micrococcus roseus*, *Micrococcus sedentarius*, *Micrococcus varians*, *Arthrobacter agilis*, *Arthrobacter albus*, *Arthrobacter atrocyaneus*, *Arthrobacter aurescens*, *Arthrobacter chlorophenolicus*, *Arthrobacter citreus*, *Arthrobacter creatinolyticus*, *Arthrobacter crystallopoietes*, *Arthrobacter cumminsii*, *Arthrobacter duodecadis*, *Arthrobacter flavescens*, *Arthrobacter flavus*, *Arthrobacter gandavensis*, *Arthrobacter globiformis*, *Arthrobacter histidinolovorans*, *Arthrobacter ilicis*, *Arthrobacter koreensis*, *Arthrobacter luteolus*, *Arthrobacter methylotrophus*, *Arthrobacter mysorens*, *Arthrobacter nasiphocae*, *Arthrobacter nicotianae*, *Arthrobacter nicotinovorans*, *Arthrobacter oxydans*, *Arthrobacter pascens*, *Arthrobacter picolinophilus*, *Arthrobacter polychromogenes*, *Arthrobacter protophormiae*, *Arthrobacter psychrolactophilus*, *Arthrobacter radiotolerans*, *Arthrobacter ramosus*, *Arthrobacter rhombi*, *Arthrobacter roseus*, *Arthrobacter siderocapsulatus*, *Arthrobacter simplex*, *Arthrobacter sulfonivorans*, *Arthrobacter sulfureus*, *Arthrobacter terregens*, *Arthrobacter tumescens*, *Arthrobacter uratoxydans*, *Arthrobacter ureafaciens*, *Arthrobacter variabilis*, *Arthrobacter viscosus*, *Arthrobacter woluwensis*, *Kocuria erythromyxa*, *Kocuria kristinae*, *Kocuria palustris*, *Kocuria polaris*, *Kocuria rhizophila*, *Kocuria rosea*, *Kocuria varians*, *Nesterenkonia halobia*, *Nesterenkonia lacusekhoensis*, *Renibacterium salmoninarum*, *Rothia amarae*, *Rothia dentocariosa*, *Rothia mucilaginosa*, *Rothia nasimurium* or *Stomatococcus mucilaginosus*; Mycobacteriaceae such as the genera *Mycobacterium* e.g. the species *Mycobacterium afficanum*, *Mycobacterium agri*, *Mycobacterium aichiense*, *Mycobacterium alvei*, *Mycobacterium asiaticum*, *Mycobacterium aurum*, *Mycobacterium austroafricanum*, *Mycobacterium bohemicum*, *Mycobacterium botniense*, *Mycobacterium brumae*, *Mycobacterium chelonae* subsp. *abscessus*, *Mycobacterium chitae*, *Mycobacterium chlorophenolicum*, *Mycobacterium chubuense*, *Mycobacterium confluentis*, *Mycobacterium cookii*, *Mycobacterium diernhoferi*, *Mycobacterium doricum*, *Mycobacterium duvalii*, *Mycobacterium fallax*, *Mycobacterium farcinogenes*, *Mycobacterium flavescens*, *Mycobacterium frederiksbergense*, *Mycobacterium gadium*, *Mycobacterium gilvum*, *Mycobacterium gordonae*, *Mycobacterium hassiacum*, *Mycobacterium hiberniae*, *Mycobacterium hodleri*, *Mycobacterium holsaticum*, *Mycobacterium komossense*, *Mycobacterium lacus*, *Mycobacterium madagascariense*, *Mycobacterium mageritense*, *Mycobacterium montefiorense*, *Mycobacterium moriokaense*, *Mycobacterium murale*, *Mycobacterium neoaurum*, *Mycobacterium nonchromogenicum*, *Mycobacterium obuense*, *Mycobacterium palustre*, *Mycobacterium parafortuitum*, *Mycobacterium peregrinum*, *Mycobacterium phlei*, *Mycobacterium pinnipedii*, *Mycobacterium poriferae*, *Mycobacterium pulveris*, *Mycobacterium rhodesiae*, *Mycobacterium shottsii*, *Mycobacterium sphagni*, *Mycobacterium terrae*, *Mycobacterium thermoresistibile*, *Mycobacterium tokaiense*, *Mycobacterium triviale*, *Mycobacterium tusciae* or *Mycobacterium vanbaalenii*; Nocardiaceae such as the genera *Nocardia*, *Rhodococcus* e.g. the species *Nocardia abscessus*, *Nocardia africana*, *Nocardia amarae*, *Nocardia asteroides*, *Nocardia autotrophica*, *Nocardia beijingensis*, *Nocardia brasiliensis*, *Nocardia brevicatena*, *Nocardia caishijiensis*, *Nocardia calcarea*, *Nocardia carnea*, *Nocardia cellulans*, *Nocardia cerradoensis*, *Nocardia coeliaca*, *Nocardia corynebacterioides*, *Nocardia crassostreae*, *Nocardia cummidelens*, *Nocardia cyriacigeorgica*, *Nocardia farcinica*, *Nocardia flavorosea*, *Nocardia fluminea*, *Nocardia globerula*, *Nocardia hydrocarbonoxydans*, *Nocardia ignorata*, *Nocardia mediterranei*, *Nocardia nova*, *Nocardia orientalis*, *Nocardia otitidiscaviarum*, *Nocardia otitidiscaviarum*, *Nocardia paucivorans*, *Nocardia petroleophila*, *Nocardia pinensis*, *Nocardia pseudobrasiliensis*, *Nocardia pseudovaccinii*, *Nocardia puris*, *Nocardia restricta*, *Nocardia rugosa*, *Nocardia salmonicida*, *Nocardia saturnea*, *Nocardia seriolae*, *Nocardia soli*, *Nocardia sulphurea*, *Nocardia transvalensis*, *Nocardia uniformis*, *Nocardia vaccinii*, *Nocardia veterana* or *Nocardia vinacea*; Pseudomonaceae such as the genera *Azomonas*, *Azotobacter*, *Cellvibrio*, *Chryseomonas*, *Flaviomonas*, *Lampropedia*, *Mesophilobacter*, *Morococcus*, *Oligella*, *Pseudomonas*, *Rhizobacter*, *Rugamonas*, *Serpens*, *Thermoleophilum*, *Xylophilus* e.g. the species *Azomonas agilis*, *Azomonas insignis*, *Azomonas macrocytogenes*, *Azotobacter agilis*, *Azotobacter agilis* subsp. *armeniae*, *Azotobacter armeniacus*, *Azotobacter beijerinckii*, *Azotobacter chroococcum*, *Azotobacter indicum*, *Azotobacter macrocytogenes*, *Azotobacter miscellum*, *Azotobacter nigricans* subsp. *nigricans*, *Azotobacter paspali*, *Azotobacter salinestris*, *Azotobacter* sp., *Azotobacter vinelandii*, *Flavimonas oryzihabitans*, *Mesophilobacter marinus*, *Oligella urethralis*, *Pseudomonas acidovorans*, *Pseudomonas aeruginosa*, *Pseudomonas agarici*, *Pseudomonas alcaligenes*, *Pseudomonas aminovorans*, *Pseudomonas amygdali*,

*Pseudomonas andropogonis, Pseudomonas anguilliseptica, Pseudomonas antarctica, Pseudomonas antimicrobica, Pseudomonas antimycetica, Pseudomonas aptata, Pseudomonas arvilla, Pseudomonas asplenii, Pseudomonas atlantica, Pseudomonas atrofaciens, Pseudomonas aureofaciens, Pseudomonas avellanae, Pseudomonas azelaica, Pseudomonas azotocolligans, Pseudomonas balearica, Pseudomonas barkeri, Pseudomonas bathycetes, Pseudomonas beijeinckii, Pseudomonas brassicacearum, Pseudomonas brenneri, Pseudomonas butanovora, Pseudomonas carboxydoflava, Pseudomonas carboxydohydrogena, Pseudomonas carboxydovorans, Pseudomonas carrageenovora, Pseudomonas caryophylli, Pseudomonas cepacia, Pseudomonas chloritidismutans, Pseudomonas chlororaphis, Pseudomonas cichorii, Pseudomonas citronellolis, Pseudomonas cocovenenans, Pseudomonas compransoris, Pseudomonas congelans, Pseudomonas coronafaciens, Pseudomonas corrugata, Pseudomonas dacunhae, Pseudomonas delafieldii, Pseudomonas delphinii, Pseudomonas denitrificans, Pseudomonas desmolytica, Pseudomonas diminuta, Pseudomonas doudoroffii, Pseudomonas echinoides, Pseudomonas elongata, Pseudomonas extorquens, Pseudomonas extremorientalis, Pseudomonas facilis, Pseudomonas ficuserectae, Pseudomonas flava, Pseudomonas flavescens, Pseudomonas fluorescens, Pseudomonas fragi, Pseudomonas frederiksbergensis, Pseudomonas fulgida, Pseudomonas fuscovaginae, Pseudomonas gazotropha, Pseudomonas gladioli, Pseudomonas glathei, Pseudomonas glumae, Pseudomonas graminis, Pseudomonas halophila, Pseudomonas helianthi, Pseudomonas huttiensis, Pseudomonas hydrogenothermophila, Pseudomonas hydrogenovora, Pseudomonas indica, Pseudomonas indigofera, Pseudomonas iodinum, Pseudomonas kilonensis, Pseudomonas lachrymans, Pseudomonas lapsa, Pseudomonas lemoignei, Pseudomonas lemonnieri, Pseudomonas lundensis, Pseudomonas luteola, Pseudomonas maltophilia, Pseudomonas marginalis, Pseudomonas marginata, Pseudomonas marina, Pseudomonas meliae, Pseudomonas mendocina, Pseudomonas mesophilica, Pseudomonas mixta, Pseudomonas monteilii, Pseudomonas morsprunorum, Pseudomonas multivorans, Pseudomonas natriegens, Pseudomonas nautica, Pseudomonas nitroreducens, Pseudomonas oleovorans, Pseudomonas oryzihabitans, Pseudomonas ovalis, Pseudomonas oxalaticus, Pseudomonas palleronii, Pseudomonas paucimobilis, Pseudomonas phaseolicola, Pseudomonas phenazinium, Pseudomonas pickettii, Pseudomonas pisi, Pseudomonas plantarii, Pseudomonas plecoglossicida, Pseudomonas poae, Pseudomonas primulae, Pseudomonas proteolytica, Pseudomonas pseudoalcaligenes, Pseudomonas pseudoalcaligenes* subsp. *konjaci, Pseudomonas pseudoalcaligenes* subsp. *pseudoalcaligenes, Pseudomonas pseudoflava, Pseudomonas putida, Pseudomonas putida* var. *naraensis, Pseudomonas putrefaciens, Pseudomonas pyrrocinia, Pseudomonas radiora, Pseudomonas reptilivora, Pseudomonas rhodesiae, Pseudomonas rhodos, Pseudomonas riboflavina, Pseudomonas rubescens, Pseudomonas rubrisubalbicans, Pseudomonas ruhlandii, Pseudomonas saccharophila, Pseudomonas savastanoi, Pseudomonas savastanoi* pvar. *glycinea, Pseudomonas savastanoi* pvar. *phaseolicola, Pseudomonas solanacearum, Pseudomonas* sp., *Pseudomonas spinosa, Pseudomonas stanieri, Pseudomonas stutzeri, Pseudomonas syringae, Pseudomonas syringae* pvar. *aptata, Pseudomonas syringae* pvar. *atrofaciens, Pseudomonas syringae* pvar. *coronafaciens, Pseudomonas syringae* pvar. *delphinii, Pseudomonas syringae* pvar. *glycinea, Pseudomonas syringae* pvar. *helianthi, Pseudomonas syringae* pvar. *lachrymans, Pseudomonas syringae* pvar. *lapsa, Pseudomonas syringae* pvar. *morsprunorum, Pseudomonas syringae* pvar. *phaseolicola, Pseudomonas syringae* pvar. *primulae, Pseudomonas syringae* pvar. *syringae, Pseudomonas syringae* pvar. *tabaci, Pseudomonas syringae* pvar. *tomato, Pseudomonas syringae* subsp. *glycinea, Pseudomonas syringae* subsp. *savastanoi, Pseudomonas syringae* subsp. *syringae, Pseudomonas syzygii, Pseudomonas tabaci, Pseudomonas taeniospiralis, Pseudomonas testosteroni, Pseudomonas thermocarboxydovorans, Pseudomonas thermotolerans, Pseudomonas thivervalensis, Pseudomonas tomato, Pseudomonas trivialis, Pseudomonas veronii, Pseudomonas vesicularis, Pseudomonas viridiflava, Pseudomonas viscogena, Pseudomonas woodsii, Rhizobacter dauci, Rhizobacter daucus* or *Xylophilus ampelinus*; Rhizobiaceae such as the genera *Agrobacterium, Carbophilus, Chelatobacter, Ensifer, Rhizobium, Sinorhizobium* e.g. the species *Agrobacterium atlanticum, Agrobacterium ferrugineum, Agrobacterium gelatinovorum, Agrobacterium lanymoorei, Agrobacterium meteori, Agrobacterium radiobacter, Agrobacterium rhizogenes, Agrobacterium rubi, Agrobacterium stellulatum, Agrobacterium tumefaciens, Agrobacterium vitis, Carbophilus carboxidus, Chelatobacter heintzii, Ensifer adhaerens, Ensifer arboris, Ensifer fredii, Ensifer kostiensis, Ensifer kummerowiae, Ensifer medicae, Ensifer meliloti, Ensifer saheli, Ensifer terangae, Ensifer xinjiangensis, Rhizobium ciceri Rhizobium etli, Rhizobium fredii, Rhizobium galegae, Rhizobium gallicum, Rhizobium giardinii, Rhizobium hainanense, Rhizobium huakuii, Rhizobium huautlense, Rhizobium indigoferae, Rhizobium japonicum, Rhizobium leguminosarum, Rhizobium loessense, Rhizobium loti, Rhizobium lupini, Rhizobium mediterraneum, Rhizobium meliloti, Rhizobium mongolense, Rhizobium phaseoli, Rhizobium radiobacter, Rhizobium rhizogenes, Rhizobium rubi, Rhizobium sullae, Rhizobium tianshanense, Rhizobium trifolii, Rhizobium tropici, Rhizobium undicola, Rhizobium vitis, Sinorhizobium adhaerens, Sinorhizobium arboris, Sinorhizobium fredii, Sinorhizobium kostiense, Sinorhizobium kummerowiae, Sinorhizobium medicae, Sinorhizobium meliloti, Sinorhizobium morelense, Sinorhizobium saheli* or *Sinorhizobium xinjiangense*; Streptomycetaceae such as the genera *Kitasatospora, Streptomyces, Streptoverticillium* e.g. the species *Streptomyces abikoensis, Streptomyces aburaviensis, Streptomyces achromogenes* subsp. *achromogenes, Streptomyces achromogenes* subsp. *rubradiris, Streptomyces acidiscabies, Streptomyces acrimycini, Streptomyces aculeolatus, Streptomyces afghaniensis, Streptomyces alanosinicus, Streptomyces albaduncus, Streptomyces albiaxialis, Streptomyces albidochromogenes, Streptomyces albidoflavus, Streptomyces albireticuli, Streptomyces albofaciens, Streptomyces alboflavus, Streptomyces albogriseolus, Streptomyces albolongus, Streptomyces alboniger, Streptomyces albospinus, Streptomyces albosporeus* subsp. *albosporeus, Streptomyces albosporeus* subsp. *labilomyceticus, Streptomyces alboverticillatus, Streptomyces albovinaceus, Streptomyces alboviridis, Streptomyces albulus, Streptomyces albus* subsp. *albus, Streptomyces albus* subsp. *pathocidicus, Streptomyces almquistii, Streptomyces althioticus, Streptomyces amakusaensis, Streptomyces ambofaciens, Streptomyces aminophilus, Streptomyces anandii, Streptomyces anthocyanicus, Streptomyces antibioticus, Streptomyces antimycoticus, Streptomyces anulatus, Streptomyces arabicus, Streptomyces ardus, Streptomyces arenae, Streptomyces argenteolus, Streptomyces armeniacus, Streptomyces asiaticus, Streptomyces asterosporus, Streptomyces atratus, Streptomyces atroaurantiacus, Streptomyces atroolivaceus, Streptomyces atrovirens, Streptomyces aurantiacus, Streptomyces*

*aurantiogriseus, Streptomyces aureocirculatus, Streptomyces aureofaciens, Streptomyces aureorectus, Streptomyces aureoversilis, Streptomyces aureoverticillatus, Streptomyces aureus, Streptomyces avellaneus, Streptomyces avermectinius, Streptomyces avermitilis, Streptomyces avidinii, Streptomyces azaticus, Streptomyces azureus, Streptomyces baarnensis, Streptomyces bacillaris, Streptomyces badius, Streptomyces baldaccii, Streptomyces bambergiensis, Streptomyces bejiangensis, Streptomyces bellus, Streptomyces bikiniensis, Streptomyces biverticillatus, Streptomyces blastmyceticus, Streptomyces bluensis, Streptomyces bobili, Streptomyces bottropensis, Streptomyces brasiliensis, Streptomyces bungoensis, Streptomyces cacaoi subsp. asoensis, Streptomyces cacaoi subsp. cacaoi, Streptomyces caelestis, Streptomyces caeruleus, Streptomyces californicus, Streptomyces calvus, Streptomyces canaries, Streptomyces candidus, Streptomyces canescens, Streptomyces cangkringensis, Streptomyces caniferus, Streptomyces canus, Streptomyces capillispiralis, Streptomyces capoamus, Streptomyces carpaticus, Streptomyces carpinensis, Streptomyces catenulae, Streptomyces caviscabies, Streptomyces cavourensis subsp. cavourensis, Streptomyces cavourensis subsp. washingtonensis, Streptomyces cellostaticus, Streptomyces celluloflavus, Streptomyces cellulolyticus, Streptomyces cellulosae, Streptomyces champavatii, Streptomyces chartreuses, Streptomyces chattanoogensis, Streptomyces chibaensis, Streptomyces chrestomyceticus, Streptomyces chromofuscus, Streptomyces chryseus, Streptomyces chrysomallus subsp. chrysomallus, Streptomyces chrysomallus subsp. fumigatus, Streptomyces cinereorectus, Streptomyces cinereoruber subsp. cinereoruber, Streptomyces cinereoruber subsp. fructofermentans, Streptomyces cinereospinus, Streptomyces cinereus, Streptomyces cinerochromogenes, Streptomyces cinnabarinus, Streptomyces cinnamonensis, Streptomyces cinnamoneus, Streptomyces cinnamoneus subsp. albosporus, Streptomyces cinnamoneus subsp. cinnamoneus, Streptomyces cinnamoneus subsp. lanosus, Streptomyces cinnamoneus subsp. sparsus, Streptomyces cirratus, Streptomyces ciscaucasicus, Streptomyces citreofluorescens, Streptomyces clavifer, Streptomyces clavuligerus, Streptomyces cochleatus, Streptomyces coelescens, Streptomyces coelicoflavus, Streptomyces coelicolor, Streptomyces coeruleoflavus, Streptomyces coeruleofuscus, Streptomyces coeruleoprunus, Streptomyces coeruleorubidus, Streptomyces coerulescens, Streptomyces collinus, Streptomyces colombiensis, Streptomyces corchorusii, Streptomyces costaricanus, Streptomyces cremeus, Streptomyces crystallinus, Streptomyces curacoi, Streptomyces cuspidosporus, Streptomyces cyaneofuscatus, Streptomyces cyaneus, Streptomyces cyanoalbus, Streptomyces cystargineus, Streptomyces daghestanicus, Streptomyces diastaticus subsp. ardesiacus, Streptomyces diastaticus subsp. diastaticus, Streptomyces diastatochromogenes, Streptomyces distallicus, Streptomyces djakartensis, Streptomyces durhamensis, Streptomyces echinatus, Streptomyces echinoruber, Streptomyces ederensis, Streptomyces ehimensis, Streptomyces endus, Streptomyces enissocaesilis, Streptomyces erumpens, Streptomyces erythraeus, Streptomyces erythrogriseus, Streptomyces eurocidicus, Streptomyces europaeiscabiei, Streptomyces eurythermus, Streptomyces exfoliates, Streptomyces felleus, Streptomyces fervens, Streptomyces fervens subsp. fervens, Streptomyces fervens subsp. melrosporus, Streptomyces flamentosus, Streptomyces filipinensis, Streptomyces fimbriatus, Streptomyces fimicarius, Streptomyces finlayi, Streptomyces flaveolus, Streptomyces flaveus, Streptomyces flavidofuscus, Streptomyces flavidovirens, Streptomyces flaviscleroticus, Streptomyces flavofungini, Streptomyces flavofuscus, Streptomyces flavogriseus, Streptomyces flavopersicus, Streptomyces flavotricini, Streptomyces flavovariabilis, Streptomyces flavovirens, Streptomyces flavoviridis, Streptomyces flocculus, Streptomyces floridae, Streptomyces fluorescens, Streptomyces fradiae, Streptomyces fragilis, Streptomyces fulvissimus, Streptomyces fulvorobeus, Streptomyces fumanus, Streptomyces fumigatiscleroticus, Streptomyces galbus, Streptomyces galilaeus, Streptomyces gancidicus, Streptomyces gardneri, Streptomyces gelaticus, Streptomyces geysiriensis, Streptomyces ghanaensis, Streptomyces gibsonii, Streptomyces glaucescens, Streptomyces glaucosporus, Streptomyces glaucus, Streptomyces globisporus subsp. caucasicus, Streptomyces globisporus subsp. flavofuscus, Streptomyces globisporus subsp. globisporus, Streptomyces globosus, Streptomyces glomeratus, Streptomyces glomeroaurantiacus, Streptomyces gobitricini, Streptomyces goshikiensis, Streptomyces gougerotii, Streptomyces graminearus, Streptomyces graminofaciens, Streptomyces griseinus, Streptomyces griseoaurantiacus, Streptomyces griseobrunneus, Streptomyces griseocameus, Streptomyces griseochromogenes, Streptomyces griseoflavus, Streptomyces griseofuscus, Streptomyces griseoincarnatus, Streptomyces griseoloalbus, Streptomyces griseolosporeus, Streptomyces griseolus, Streptomyces griseoluteus, Streptomyces griseomycini, Streptomyces griseoplanus, Streptomyces griseorubens, Streptomyces griseoruber, Streptomyces griseorubiginosus, Streptomyces griseosporeus, Streptomyces griseostramineus, Streptomyces griseoverticillatus, Streptomyces griseoviridis, Streptomyces griseus subsp. alpha, Streptomyces griseus subsp. cretosus, Streptomyces griseus subsp. griseus, Streptomyces griseus subsp. solvifaciens, Streptomyces hachijoensis, Streptomyces halstedii, Streptomyces hawaiiensis, Streptomyces heliomycini, Streptomyces helvaticus, Streptomyces herbaricolor, Streptomyces hiroshimensis, Streptomyces hirsutus, Streptomyces humidus, Streptomyces humiferus, Streptomyces hydrogenans, Streptomyces hygroscopicus subsp. angustmyceticus, Streptomyces hygroscopicus subsp. decoyicus, Streptomyces hygroscopicus subsp. glebosus, Streptomyces hygroscopicus subsp. hygroscopicus, Streptomyces hygroscopicus subsp. ossamyceticus, Streptomyces iakyrus, Streptomyces indiaensis, Streptomyces indigoferus, Streptomyces indonesiensis, Streptomyces intermedius, Streptomyces inusitatus, Streptomyces ipomoeae, Streptomyces janthinus, Streptomyces javensis, Streptomyces kanamyceticus, Streptomyces kashmirensis, Streptomyces kasugaensis, Streptomyces katrae, Streptomyces kentuckensis, Streptomyces kifunensis, Streptomyces kishiwadensis, Streptomyces kunmingensis, Streptomyces kurssanovii, Streptomyces labedae, Streptomyces laceyi, Streptomyces ladakanum, Streptomyces lanatus, Streptomyces lateritius, Streptomyces laurentii, Streptomyces lavendofoliae, Streptomyces lavendulae subsp. grasserius, Streptomyces lavendulae subsp. lavendulae, Streptomyces lavenduligriseus, Streptomyces lavendulocolor, Streptomyces levis, Streptomyces libani subsp. libani, Streptomyces libani subsp. rufus, Streptomyces lienomycini, Streptomyces lilacinus, Streptomyces limosus, Streptomyces lincolnensis, Streptomyces lipmanii, Streptomyces litmocidini, Streptomyces lomondensis, Streptomyces longisporoflavus, Streptomyces longispororuber, Streptomyces longisporus, Streptomyces longwoodensis, Streptomyces lucensis, Streptomyces luridiscabiei, Streptomyces luridus, Streptomyces lusitanus, Streptomyces luteireticuli, Streptomyces luteogriseus, Streptomyces luteosporeus, Streptomyces luteoverticillatus, Streptomyces lydicus, Streptomyces macrosporus, Streptomyces malachitofuscus, Streptomyces malachitospinus, Streptomyces malaysiensis, Streptomyces mashuensis, Streptomyces massasporeus, Streptomyces mat-* ensis, Streptomyces mauvecolor, Streptomyces mediocidicus, Streptomyces mediolani, Streptomyces megasporus, Streptomyces melanogenes, Streptomyces melanosporofaciens, Streptomyces mexicanus, Streptomyces michiganensis, Streptomyces microflavus, Streptomyces minutiscleroticus, Streptomyces mirabilis, Streptomyces misakiensis, Streptomyces misionensis, Streptomyces mobaraensis, Streptomyces monomycini, Streptomyces morookaensis, Streptomyces murinus, Streptomyces mutabilis, Streptomyces mutomycini, Streptomyces naganishii, Streptomyces narbonensis, Streptomyces nashvillensis, Streptomyces netropsis, Streptomyces neyagawaensis, Streptomyces niger, Streptomyces nigrescens, Streptomyces nigrifaciens, Streptomyces nitrosporus, Streptomyces niveiciscabiei, Streptomyces niveoruber, Streptomyces niveus, Streptomyces noboritoensis, Streptomyces nodosus, Streptomyces nogalater, Streptomyces nojiriensis, Streptomyces noursei, Streptomyces novaecaesareae, Streptomyces ochraceiscleroticus, Streptomyces odorifer, Streptomyces olivaceiscleroticus, Streptomyces olivaceoviridis, Streptomyces olivaceus, Streptomyces olivochromogenes, Streptomyces olivomycini, Streptomyces olivoreticuli, Streptomyces olivoreticuli subsp. cellulophilus, Streptomyces olivoreticuli subsp. olivoreticuli, Streptomyces olivoverticillatus, Streptomyces olivoviridis, Streptomyces omiyaensis, Streptomyces orinoci, Streptomyces pactum, Streptomyces paracochleatus, Streptomyces paradoxus, Streptomyces parvisporogenes, Streptomyces parvulus, Streptomyces parvus, Streptomyces peucetius, Streptomyces phaeochromogenes, Streptomyces phaeofaciens, Streptomyces phaeopurpureus, Streptomyces phaeoviridis, Streptomyces phosalacineus, Streptomyces pilosus, Streptomyces platensis, Streptomyces plicatus, Streptomyces pluricolorescens, Streptomyces polychromogenes, Streptomyces poonensis, Streptomyces praecox, Streptomyces prasinopilosus, Streptomyces prasinosporus, Streptomyces prasinus, Streptomyces prunicolor, Streptomyces psammoticus, Streptomyces pseudoechinosporeus, Streptomyces pseudogriseolus, Streptomyces pseudovenezuelae, Streptomyces pulveraceus, Streptomyces puniceus, Streptomyces puniciscabiei, Streptomyces purpeofuscus, Streptomyces purpurascens, Streptomyces purpureus, Streptomyces purpurogeneiscleroticus, Streptomyces racemochromogenes, Streptomyces rameus, Streptomyces ramuilosus, Streptomyces rangoonensis, Streptomyces recifensis, Streptomyces rectiverticillatus, Streptomyces rectiviolaceus, Streptomyces regensis, Streptomyces resistomycificus, Streptomyces reticuliscabiei, Streptomyces rhizosphaericus, Streptomyces rimosus subsp. paromomycinus, Streptomyces rimosus subsp. rimosus, Streptomyces rishiriensis, Streptomyces rochei, Streptomyces roseiscleroticus, Streptomyces roseodiastaticus, Streptomyces roseoflavus, Streptomyces roseofulvus, Streptomyces roseolilacinus, Streptomyces roseolus, Streptomyces roseosporus, Streptomyces roseoverticillatus, Streptomyces roseoviolaceus, Streptomyces roseoviridis, Streptomyces rubber, Streptomyces rubiginosohelvolus, Streptomyces rubiginosus, Streptomyces rubrogriseus, Streptomyces rutgersensis subsp. castelarensis, Streptomyces rutgersensis subsp. rutgersensis, Streptomyces salmonis, Streptomyces sampsonii, Streptomyces sanglieri, Streptomyces sannanensis, Streptomyces sapporonensis, Streptomyces scabiei, Streptomyces sclerotialus, Streptomyces scopiformis, Streptomyces seoulensis, Streptomyces septatus, Streptomyces setae, Streptomyces setonii, Streptomyces showdoensis, Streptomyces sindenensis, Streptomyces sioyaensis, Streptomyces somaliensis, Streptomyces sparsogenes, Streptomyces spectabilis, Streptomyces speibonae, Streptomyces speleomycini, Streptomyces spheroids, Streptomyces spinoverrucosus, Streptomyces spiralis, Streptomyces spiroverticillatus, Streptomyces spitsbergensis, Streptomyces sporocinereus, Streptomyces sporoclivatus, Streptomyces spororaveus, Streptomyces sporoverrucosus, Streptomyces stelliscabiei, Streptomyces stramineus, Streptomyces subrutilus, Streptomyces sulfonofaciens, Streptomyces sulphurous, Streptomyces syringium, Streptomyces tanashiensis, Streptomyces tauricus, Streptomyces tendae, Streptomyces termitum, Streptomyces thermoalcalitolerans, Streptomyces thermoautotrophicus, Streptomyces thermocarboxydovorans, Streptomyces thermocarboxydus, Streptomyces thermocoprophilus, Streptomyces thermodiastaticus, Streptomyces thermogriseus, Streptomyces thermolineatus, Streptomyces thermonitrificans, Streptomyces thermospinosisporus, Streptomyces thermoviolaceus subsp. apingens, Streptomyces thermoviolaceus subsp. thermoviolaceus, Streptomyces thermovulgaris, Streptomyces thioluteus, Streptomyces torulosus, Streptomyces toxytricini, Streptomyces tricolor, Streptomyces tubercidicus, Streptomyces tuirus, Streptomyces turgidiscabies, Streptomyces umbrinus, Streptomyces variabilis, Streptomyces variegates, Streptomyces varsoviensis, Streptomyces vastus, Streptomyces venezuelae, Streptomyces vinaceus, Streptomyces vinaceusdrappus, Streptomyces violaceochromogenes, Streptomyces violaceolatus, Streptomyces violaceorectus, Streptomyces violaceoruber, Streptomyces violaceorubidus, Streptomyces violaceus, Streptomyces violaceusniger, Streptomyces violarus, Streptomyces violascens, Streptomyces violatus, Streptomyces violens, Streptomyces virens, Streptomyces virginiae, Streptomyces viridiflavus, Streptomyces viridiviolaceus, Streptomyces viridobrunneus, Streptomyces viridochromogenes, Streptomyces viridodiastaticus, Streptomyces viridosporus, Streptomyces vitaminophileus, Streptomyces vitaminophilus, Streptomyces wedmorensis, Streptomyces werraensis, Streptomyces willmorei, Streptomyces xanthochromogenes, Streptomyces xanthocidicus, Streptomyces xantholiticus, Streptomyces xanthophaeus, Streptomyces yatensis, Streptomyces yerevanensis, Streptomyces yogyakartensis, Streptomyces yokosukanensis, Streptomyces yunnanensis, Streptomyces zaomyceticus, Streptoverticillium abikoense, Streptoverticillium albireticuli, Streptoverticillium alboverticillatum, Streptoverticillium album, Streptoverticillium ardum, Streptoverticillium aureoversale, Streptoverticillium aureoversile, Streptoverticillium baldaccii, Streptoverticillium biverticillatum, Streptoverticillium blastmyceticum, Streptoverticillium cinnamoneum subsp. albosporum, Streptomyces cinnamoneus subsp. albosporus, Streptoverticillium cinnamoneum subsp. cinnamoneum, Streptoverticillium cinnamoneum subsp. lanosum, Streptoverticillium cinnamoneum subsp. sparsum, Streptoverticillium distallicum, Streptoverticillium ehimense, Streptoverticillium eurocidicum, Streptoverticillium fervens subsp. fervens, Streptoverticillium fervens subsp. melrosporus, Streptoverticillium flavopersicum, Streptoverticillium griseocarneum, Streptoverticillium griseoverticillatum, Streptoverticillium hachijoense, Streptoverticillium hiroshimense, Streptoverticillium kashmirense, Streptoverticillium kentuckense, Streptoverticillium kishiwadense, Streptoverticillium ladakanum, Streptoverticillium lavenduligriseum, Streptoverticillium lilacinum, Streptoverticillium luteoverticillatum, Streptoverticillium mashuense, Streptoverticillium mobaraense, Streptoverticillium morookaense, Streptoverticillium netropsis, Streptoverticillium olivomycini, Streptomyces olivomycini, Streptoverticillium olivoreticuli subsp. cellulophilum, Streptoverticillium olivoreticuli subsp. olivoreticuli, Streptoverticillium olivoreticulum, Streptoverticillium olivoreticulum subsp. cellulophilum, Streptoverticillium olivoverticillatum, Streptoverticillium orinoci, Strep-

*toverticillium parvisporogenes, Streptoverticillium parvisporogenum, Streptoverticillium rectiverticillatum, Streptoverticillium reticulum* subsp. *protomycicum, Streptoverticillium roseoverticillatum, Streptoverticillium salmonis, Streptoverticillium sapporonense, Streptovefticillium septatum, Streptoverticillium syringium, Streptoverticillium thioluteum, Streptoverticillium verticillium* subsp. *quantum, Streptoverticillium verticillium* subsp. *tsukushiense* or *Streptoverticillium viridoflavum.*

Particular preferred strains are strains selected from the group consisting of Bacillaceae, Brevibacteriaceae, Corynebacteriaceae, Nocardiaceae, Mycobacteriaceae, Streptomycetaceae, Enterobacteriaceae such as *Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp., *Nocardia rhodochrous* (*Rhodococcus rhodochrous*), *Mycobacterium rhodochrous, Streptomyces lividans* and *Escherichia coli* especially *Escherichia coli* K12.

In addition particular preferred strains are strains selected from the group consisting of Cryptococcaceae, Saccharomycetaceae, Schizosaccharomycetacease such as the genera *Candida, Hansenula, Pichia, Saccharomyces* and *Schizosaccharomyces* preferred are strains selected from the group consisting of the species *Rhodotorula rubra, Rhodotorula glutinis, Rhodotorula graminis, Yarrowia lipolytica, Sporobolomyces salmonicolor, Sporobolomyces shibatanus, Saccharomyces cerevisiae, Candida boidinii, Candida bombicola, Candida cylindracea, Candida parapsilosis, Candida rugosa, Candida tropicalis, Pichia methanolica* and *Pichia pastoris* especially *Saccharomyces cerevisiae.*

Anacardiaceae such as the genera *Pistacia, Mangifera, Anacardium* e.g. the species *Pistacia vera* [pistachios, Pistazie], *Mangifer indica* [Mango] or *Anacardium occidentale* [Cashew]; Asteraceae such as the genera *Calendula, Carthamus, Centaurea, Cichorium, Cynara, Helianthus, Lactuca, Locusta, Tagetes, Valeriana* e.g. the species *Calendula officinalis* [Marigold], *Carthamus tinctorius* [safflower], *Centaurea cyanus* [cornflower], *Cichorium intybus* [blue daisy], *Cynara scolymus* [Artichoke], *Helianthus annus* [sunflower], *Lactuca sativa, Lactuca crispa, Lactuca esculenta, Lactuca scariola* L. ssp. *sativa, Lactuca scariola* L. var. *integrata, Lactuca scariola* L. var. *integrifolia, Lactuca sativa* subsp. *romana, Locusta communis, Valeriana locusta* [lettuce], *Tagetes lucida, Tagetes erecta* or *Tagetes tenuifolia* [Marigold]; Apiaceae such as the genera *Daucus* e.g. the species *Daucus carota* [carrot]; Betulaceae such as the genera *Corylus* e.g. the species *Corylus avellana* or *Corylus columa* [hazelnut]; Boraginaceae such as the genera *Borago* e.g. the species *Borago officinalis* [borage]; Brassicaceae such as the genera *Brassica, Melanosinapis, Sinapis, Arabadopsis* e.g. the species *Brassica napus, Brassica rapa* ssp. [canola, oilseed rape, turnip rape], *Sinapis arvensis, Brassica juncea, Brassica juncea* var. *juncea, Brassica juncea* var. *crispifolia, Brassica juncea* var. *foliosa, Brassica nigra, Brassica sinapioides, Melanosinapis communis* [mustard], *Brassica oleracea* [fodder beet] or *Arabidopsis thaliana*; Bromeliaceae such as the genera *Anana, Bromelia* e.g. the species *Anana comosus, Ananas ananas* or *Bromelia comosa* [pineapple]; Caricaceae such as the genera *Carica* e.g. the species *Carica papaya* [papaya]; Cannabaceae such as the genera *Cannabis* e.g. the species *Cannabis sative* [hemp], Convolvulaceae such as the genera *Ipomea, Convolvulus* e.g. the species *Ipomoea batatus, Ipomoea pandurata, Convolvulus batatas, Convolvulus tiliaceus, Ipomoea fastigiata, Ipomoea tiliacea, Ipomoea triloba* or *Convolvulus panduratus* [sweet potato, Man of the Earth, wild potato], Chenopodiaceae such as the genera *Beta*, i.e. the species *Beta vulgaris, Beta vulgaris* var. *altissima, Beta vulgaris* var. *Vulgaris, Beta maritima, Beta vulgaris* var. *perennis, Beta vulgaris* var. *conditiva* or *Beta vulgaris* var. *esculenta* [sugar beet]; Cucurbitaceae such as the genera *Cucurbita* e.g. the species *Cucurbita maxima, Cucurbita mixta, Cucurbita pepo* or *Cucurbita moschata* [pumpkin, squash]; Elaeagnaceae such as the genera *Elaeagnus* e.g. the species *Olea europaea* [olive]; Ericaceae such as the genera *Kalmia* e.g. the species *Kalmia latifolia, Kalmia angustifolia, Kalmia microphylla, Kalmia polifolia, Kalmia occidentalis, Cistus chamaerhodendros* or *Kalmia lucida* [American laurel, broad-leafed laurel, calico bush, spoon wood, sheep laurel, alpine laurel, bog laurel, western bog-laurel, swamp-laurel]; Euphorbiaceae such as the genera *Manihot, Janipha, Jatropha, Ricinus* e.g. the species *Manihot utilissima, Janipha manihot, Jatropha manihot, Manihot aipil, Manihot dulcis, Manihot manihot, Manihot melanobasis, Manihot esculenta* [manihot, arrowroot, tapioca, cassava] or *Ricinus communis* [castor bean, Castor Oil Bush, Castor Oil Plant, Palma Christi, Wonder Tree]; Fabaceae such as the genera *Pisum, Albizia, Cathormion, Feuillea, Inga, Pithecolobium, Acacia, Mimosa, Medicajo, Glycine, Dolichos, Phaseolus, Soja* e.g. the species *Pisum sativum, Pisum arvense, Pisum humile* [pea], *Albizia berteriana, Albizia julibrissin, Albizia lebbeck, Acacia berteriana, Acacia littoralis, Albizia berteriana, Albizzia berteriana, Cathormion berteriana, Feuillea berteriana, Inga fragrans, Pithecellobium berterianum, Pithecellobium fragrans, Pithecolobium berterianum, Pseudalbizzia berteriana, Acacia julibrissin, Acacia nemu, Albizia nemu, Feuilleea julibrissin, Mimosa julibrissin, Mimosa speciosa, Sericanrda julibrissin, Acacia lebbeck, Acacia macrophylla, Albizia lebbek, Feuilleea lebbeck, Mimosa lebbeck, Mimosa speciosa* [bastard logwood, silk tree, East Indian Walnut], *Medicago sativa, Medicago falcata, Medicago varia* [alfalfa] *Glycine max Dolichos soja, Glycine gracilis, Glycine hispida, Phaseolus max, Soja hispida* or *Soja max* [soybean]; Geraniaceae such as the genera *Pelargonium, Cocos, Oleum* e.g. the species *Cocos nucifera, Pelargonium grossularioides* or *Oleum cocois* [coconut]; Gramineae such as the genera *Saccharum* e.g. the species *Saccharum officinarum*; Juglandaceae such as the genera *Juglans, Wallia* e.g. the species *Juglans regia, Juglans ailanthifolia, Juglans sieboldiana, Juglans cinerea, Wallia cinerea, Juglans bixbyi, Juglans californica, Juglans hindsii, Juglans intermedia, Juglans jamaicensis, Juglans major, Juglans microcarpa, Juglans nigra* or *Wallia nigra* [walnut, black walnut, common walnut, persian walnut, white walnut, butternut, black walnut]; Lauraceae such as the genera *Persea, Laurus* e.g. the species laurel *Laurus nobilis* [bay, laurel, bay laurel, sweet bay], *Persea americana, Persea americana, Persea gratissima* or *Persea persea* [avocado]; Leguminosae such as the genera *Arachis* e.g. the species *Arachis hypogaea* [peanut]; Linaceae such as the genera *Linum, Adenolinum* e.g. the species *Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense* or *Linum trigynum* [flax, linseed]; Lythrarieae such as the genera *Punica* e.g. the species *Punica granatum* [pomegranate]; Malvaceae such as the genera *Gossypium* e.g. the species *Gossypium hirsutum, Gossypium arboreum, Gossypium barbadense, Gossypium herbaceum* or *Gossypium thurberi* [cotton]; Musaceae such as the genera *Musa* e.g. the species *Musa nana, Musa acuminata, Musa paradisiaca, Musa* spp. [banana]; Onagraceae such as the genera *Camissonia, Oenothera* e.g. the species *Oenothera biennis* or *Camissonia brevipes* [primrose, evening primrose]; Palmae such as the genera *Elacis* e.g. the species *Elaeis guineensis* [oil plam]; Papaveraceae such as the genera *Papaver* e.g. the species *Papaver orientale, Papaver rhoeas, Papaver dubium* [poppy, oriental poppy, corn poppy, field poppy, shirley poppies, field poppy, long-headed poppy, long-pod poppy]; Pedaliaceae such as the genera *Sesamum* e.g. the species *Sesamum indicum* [sesame]; Piperaceae such as the genera *Piper, Artanthe, Peperomia, Steffensia* e.g. the species *Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata.* [Cayenne pepper, wild pepper]; Poaceae such as the genera *Hordeum, Secale, Avena, Sorghum, Andropogon, Holcus, Panicum, Oryza, Zea, Triticum* e.g. the species *Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum* [barley, pearl barley, foxtail barley, wall barley, meadow barley], *Secale cereale* [rye], *Avena sativa, Avena fatua, Avena byzantina, Avena fatua* var. *sativa, Avena hybrida* [oat], *Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum* [Sorghum, millet], *Oryza sativa, Oryza latifolia* [rice], *Zea mays* [corn, maize] *Triticum aestivum, Triticum durum, Triticum turgidum, Triticum hybernum, Triticum macha, Triticum sativum* or *Triticum vulgare* [wheat, bread wheat, common wheat], Proteaceae such as the genera *Macadamia* e.g. the species *Macadamia intergrifolia* [macadamia]; Rubiaceae such as the genera *Coffea* e.g. the species *Coffea* spp., *Coffea arabica, Coffea canephora* or *Coffea liberica* [coffee]; Scrophulariaceae such as the genera *Verbascum* e.g. the species *Verbascum blattaria, Verbascum chaixii, Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum* or *Verbascum thapsus* [mullein, white moth mullein, nettle-leaved mullein, dense-flowered mullein, silver mullein, long-leaved mullein, white mullein, dark mullein, greek mullein, orange mullein, purple mullein, hoary mullein, great mullein]; Solanaceae such as the genera *Capsicum, Nicotiana, Solanum, Lycopersicon* e.g. the species *Capsicum annuum, Capsicum annuum* var. *glabriusculum, Capsicum frutescens* [pepper], *Capsicum annuum* [paprika], *Nicotiana tabacum, Nicotiana alata, Nicotiana attenuata, Nicotiana glauca, Nicotiana langsdorffi, Nicotiana obtusifolia, Nicotiana quadrivalvis, Nicotiana repanda, Nicotiana rustica, Nicotiana sylvestris* [tobacco], *Solanum tuberosum* [potato], *Solanum melongena* [egg-plant] (*Lycopersicum esculentum, Lycopersicum lycopersicum, Lycopersicum pyriforme, Solanum integrifolium* or *Solanum lycopersicum* [tomato]; Sterculiaceae such as the genera *Theobroma* e.g. the species *Theobroma cacao* [cacao]; Theaceae such as the genera *Camellia* e.g. the species *Camellia sinensis*) [tea].

All abovementioned organisms can in princible also function as host organisms.

Particular preferred plants are plants selected from the group consisting of Asteraceae such as the genera *Helianthus, Tagetes* e.g. the species *Helianthus annus* [sunflower], *Tagetes lucida, Tagetes erecta* or *Tagetes tenuifolia* [Marigold]; Brassicaceae such as the genera *Brassica, Arabadopsis* e.g. the species *Brassica napus, Brassica rapa* ssp., *Brassica juncea* [canola, oilseed rape, turnip rape] or *Arabidopsis thaliana*; Fabaceae such as the genera *Glycine* e.g. the species *Glycine max, Soja hispida* or *Soja max* [soybean]; Linaceae such as the genera *Linum* e.g. the species *Linum usitatissimum*, [flax, linseed]; Poaceae such as the genera *Hordeum, Secale, Avena, Sorghum, Oryza, Zea, Triticum* e.g. the species *Hordeum vulgare* [barley]; *Secale cereale* [rye], *Avena sativa, Avena fatua, Avena byzantina, Avena fatua* var. *sativa, Avena hybrida* [oat], *Sorghum bicolor* [Sorghum, millet], *Oryza sativa, Oryza latifolia* [rice], *Zea mays* [corn, maize] *Triticum aestivum, Triticum durum, Triticum turgidum, Triticum hybernum, Triticum macha, Triticum sativum* or *Triticum vulgare* [wheat, bread wheat, common wheat]; Solanaceae such as the genera *Solanum, Lycopersicon* e.g. the species *Solanum tuberosum* [potato], *Lycopersicon esculentum, Lycopersicon lycopersicum, Lycopersicon pyriforme, Solanum integrifolium* or *Solanum lycopersicum* [tomato].

All abovementioned organisms can in princible also function as host organisms.

With regard to the nucleic acid sequence as depicted below a nucleic acid construct which contains a nucleic acid sequence mentioned herein or an organism (=transgenic organism) which is transformed with said nucleic acid sequence or said nucleic acid construct, "transgene" means all those constructs which have been brought about by genetic manipulation methods, preferably in which either a) the nucleic acid sequence as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 or a derivative thereof, or b) a genetic regulatory element, for example a promoter, which is functionally linked to the nucleic acid sequence as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 or a derivative thereof, or c) (a) and (b)

is/are not present in its/their natural genetic environment or has/have been modified by means of genetic manipulation methods, it being possible for the modification to be, by way of example, a substitution, addition, deletion, inversion or insertion of one or more nucleotide. "Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

The use of the nucleic acid sequence according to the invention or of the nucleic acid construct according to the invention for the generation of transgenic plants is therefore also subject matter of the invention.

The fine chemical, which is synthesized in the organism, in particular the microorganism, the cell, the tissue or the plant, of the invention can be isolated if desired. Depending on the use of the fine chemical, different purities resulting from the purification may be advantageous as will be described herein below.

In an advantageous embodiment of the invention, the organism takes the form of a plant whose fine chemical content is modified advantageously owing to the nucleic acid molecule of the present invention expressed. This is important for plant breeders since, for example, the nutritional value of organisms such as a plant is very often limited by its amino acid, protein, co-factor and/or vitamin content to mention only a couple of them. For example in feed for monogastric animals a few essential amino acids such as lysine, threonine or methionine are very often limiting. After the biological activity of the nucleic acid and/or protein of the invention has been increased or generated, or after the expression of nucleic acid molecule or polypeptide according to the invention has been generated or increased, the transgenic plant generated thus is grown on or in a nutrient medium or else in the soil and subsequently harvested.

The plants or parts thereof, e.g. the leaves, roots, flowers, and/or stems and/or other harvestable material as described below, can then be used directly as foodstuffs or animal feeds or else be further processed. Again, the amino acids can be purified further in the customary manner via extraction and precipitation or via ion exchangers and other methods known to the person skilled in the art and described herein below. Products which are suitable for various applications and which result from these different processing procedures are for example amino acids or amino acid compositions which can still comprise further plant components in different amounts, advantageously in the range of from 0 to 99% by weight or more, preferably from below 90%, 80%, 70%, 60% or 50% by weight, especially preferably below 40%, 30%, 20% or 10% by weight. The plants can also advantageously be used directly without further processing, e.g. as feed or for extraction.

The chemically pure fine chemical or chemically pure compositions comprising the fine chemical may also be produced by the process described above. To this end, the fine chemical or the compositions are isolated in the known manner from an organism according to the invention, such as the microorganisms, non-human animal or the plants, and/or their culture medium in which or on which the organisms had been grown. These chemically pure fine chemical or said compositions are advantageous for applications in the field of the food industry, the cosmetics industry or the pharmaceutical industry.

Thus, the content of plant components and preferably also further impurities is as low as possible, and the abovementioned fine chemical are obtained in as pure form as possible. In these applications, the content of plant components advantageously amounts to less than 10% by weight, preferably 1% by weight, more preferably 0.1% by weight, very especially preferably 0.01% by weight or less.

Accordingly, the fine chemical produced by the present invention is at least 0.1% by weight pure, preferably more than 1% by weight pure, more preferred 10% by weight pure, even more preferred are more than 50%, 60%, 70% or 80% by weight pure, even more preferred are more than 90%, 91%, 92%, 93%, 94% or 95% weight pure, most preferred are 96%, 97%, 98% or 99% by weight or more pure.

In this context, the amount of the fine chemical in a cell of the invention may be increased according to the process of the invention by at least a factor of 1.1, preferably at least a factor of 1.5; 2; or 5, especially preferably by at least a factor of 10 or 30, very especially preferably by at least a factor of 50, in comparison with the wild type, control or reference. Preferably, said increase is found in a tissue of an organism, more preferred in the organism itself or in a harvestable part thereof.

In principle, the fine chemicals produced can be increased in two ways by the process according to the invention. The pool of free fine chemicals, in particular of the free fine chemical, and/or the content of bound for example protein-bound fine chemicals, in particular of the protein-bound fine chemical may advantageously be increased.

It may be advantageous to increase the pool of free fine chemical in the transgenic organisms by the process according to the invention in order to isolate high amounts of the pure fine chemical.

In another preferred embodiment of the invention a combination of the increased expression of the nucleic acid sequence or the protein of the invention together with the transformation of a protein or polypeptid, which functions as a sink for the desired fine chemical such as an amino acid for example methionine, lysine or threonine in the organism is useful to increase the production of the fine chemical (see U.S. Pat. No. 5,589,616, WO 96/38574, WO 97/07665, WO 97/28247, U.S. Pat. No. 4,886,878, U.S. Pat. No. 5,082,993 and U.S. Pat. No. 5,670,635). Galili et al. [Transgenic Res. 2000] showed, that enhancing the synthesis of threonine by a feed back insensitive aspertate kinase did not lead only to in increase in free threonine but also in protein bound threonine.

In may also be advantageous to increase the content of the bound fine chemical.

In a preferred embodiment, the fine chemical is produced in accordance with the invention and, if desired, is isolated. The production of further fine chemicals for example amino acids such as lysine and of amino acid mixtures by the process according to the invention is advantageous.

In the case of the fermentation of microorganisms, the abovementioned fine chemical e.g. amino acid or mixtures of amino acids may accumulate in the medium and/or the cells. If microorganisms are used in the process according to the invention, the fermentation broth can be processed after the cultivation. Depending on the requirement, all or some of the biomass can be removed from the fermentation broth by separation methods such as, for example, centrifugation, filtration, decanting or a combination of these methods, or else the biomass can be left in the fermentation broth. The fermentation broth can subsequently be reduced, or concentrated, with the aid of known methods such as, for example, rotary evaporator, thin-layer evaporator, falling film evaporator, by reverse osmosis or by nanofiltration. This concentrated fermentation broth can subsequently be processed by lyophilization, spray drying, spray granulation or by other methods.

To purify a fine chemical such as an amino acid, a product-containing fermentation broth from which the biomass has been separated may be subjected to chromatography with a suitable resin such as ion exchange resin for example anion or cation exchange resin, hydrophobic resin or hydrophilic resin for example epoxy resin, polyurethane resin or polyacrylamid resin, or resin for separation according to the molecular weight of the compounds for example polyvinyl chloride homopolymer resin or resins composed for example of polymers of acrylic acid, crosslinked with polyalkenyl ethers or divinyl glycol such as Carbopol®, Pemulen® and Noveon®. If necessary these chromatography steps may be repeated using the same or other chromatography resins. The skilled worker is familiar with the choice of suitable chromatography resins and their most effective use. The purified product may be concentrated by filtration or ultrafiltration and stored at a temperature, which ensures the maximum stability of the product.

The identity and purity of the compound(s) isolated can be determined by prior-art techniques. They encompass high-performance liquid chromatography (HPLC), spectroscopic methods, mass spectrometry (MS), staining methods, thin-layer chromatography, NIRS, enzyme assays or microbiological assays. These analytical methods are compiled in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Bd. A27, VCH Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Fine chemicals like amino acids can for example be detected advantageously via HPLC separation in ethanolic extract as described by Geigenberger et al. (Plant Cell & Environ, 19, 1996: 43-55). Amino acids can be extracted with hot water. After filtration the extracts are diluted with water containing 20 mg/mL sodium acide. The separation and detection of the amino acids is performed using an anion exchange column and an electrochemical detector. Technical details can be taken from Y. Ding et al., 2002, Direct determination of free amino acids and sugars in green tea by anion-exchange chromatography with integrated pulsed amperometric detection, J Chromatogr A, (2002) 982; 237-244, or e.g. from Karchi et al., 1993, Plant J. 3: 721-727; Matthews M J, 1997 (Lysine, threonine and methionine biosynthesis. In B K Singh, ed, Plant Amino Acids: Biochemistry and Biotechnology. Dekker, New York, pp 205-225; H Hesse and R Hoefgen. (2003) Molecular aspects of methionine biosynthesis. TIPS 8(259-262.

In a preferred embodiment, the present invention relates to a process for the production of the fine chemical comprising or generating in an organism or a part thereof the expression of at least one nucleic acid molecule comprising a nucleic acid molecule selected from the group consisting of:

a) nucleic acid molecule encoding, preferably at least the mature form, of the polypeptide as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or a fragment thereof, which confers an increase in the amount of the fine chemical in an organism or a part thereof;

b) nucleic acid molecule comprising, preferably at least the mature form, of the nucleic acid molecule as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393;

c) nucleic acid molecule whose sequence can be deduced from a polypeptide sequence encoded by a nucleic acid molecule of (a) or (b) as result of the degeneracy of the genetic code and conferring an increase in the amount of the fine chemical in an organism or a part thereof;

d) nucleic acid molecule encoding a polypeptide which has at least 50% identity with the amino acid sequence of the polypeptide encoded by the nucleic acid molecule of (a) to (c) and conferring an increase in the amount of the fine chemical in an organism or a part thereof;

e) nucleic acid molecule which hybidizes with a nucleic acid molecule of (a) to (c) under under stringent hybridisation conditions and conferring an increase in the amount of the fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c) and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule comprising a nucleic acid molecule which is obtained by amplifying nucleic acid molecules from a cDNA library or a genomic library using the primers as depicted in SEQ ID NO: 53 or SEQ ID NO: 54 and conferring an increase in the amount of the fine chemical in an organism or a part thereof;

i) nucleic acid molecule encoding a polypeptide which is isolated, e.g. from an expression library, with the aid of monoclonal antibodies against a polypeptide encoded by one of the nucleic acid molecules of (a) to (h), preferably to (a) to (c), and and conferring an increase in the amount of the fine chemical in an organism or a part thereof;

j) nucleic acid molecule which encodes a polypeptide comprising the consensus sequence as depicted in SEQ ID NO: 47, SEQ ID NO: 48, SEQ ID NO: 49, SEQ ID NO: 50, SEQ ID NO: 51, SEQ ID NO: 52, SEQ ID NO: 397, SEQ ID NO: 398, SEQ ID NO: 399 and/or SEQ ID NO: 400 and conferring an increase in the amount of the fine chemical in an organism or a part thereof; and/or k) nucleic acid molecule which is obtainable by screening a suitable library under stringent conditions with a probe comprising one of the sequences of the nucleic acid molecule of (a) to a), preferably to (a) to (c), or with a fragment of at least 15 nt, preferably 20 nt, 30 nt, 50 nt, 100 nt, 200 nt or 500 nt of the nucleic acid molecule characterized in (a) to (j), preferably to (a) to (c), and conferring an increase in the amount of the fine chemical in an organism or a part thereof;

or which comprises a sequence which is complementary thereto.

In one embodiment, the nucleic acid molecule used in the process distinguishes over the sequence as depicted in SEQ ID NO: 1, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 by one or more nucleotides or does not consist of the sequence as depicted in SEQ ID NO: 1, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393. In another embodiment, the nucleic acid molecule does not encode a polypeptide of the sequence as depicted in SEQ ID NO: 2, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394. In another embodiment, the nucleic acid molecule of the present invention is less than 100%, 99.999%, 99.99%, 99.9% or 99% identical to the sequence as depicted in SEQ ID NO: 2, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394. In another embodiment, the nucleic acid molecule encodes a polypeptide of the sequence as depicted in SEQ ID NO: 2, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 and distinguishes over said sequence by one or more amino acids preferably by 1, 2, 3, 4, 5, 6, 7, 8, 9 or 10 amino acids. In further another advantageously embodiment, the nucleic acid molecule used in the process distinguishes over the sequence as depicted in SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41 SEQ ID NO: 43 or SEQ ID NO: 45 by one or more nucleotides or does not consist of the sequence as depicted in SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41 SEQ ID NO: 43 or SEQ ID NO: 45. In one advantageously embodiment, the nucleic acid molecule of the present invention is less than 100%, 99.999%, 99.99%, 99.9% or 99% identical to the sequence as depicted in SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41 SEQ ID NO: 43 or SEQ ID NO: 45. In another advantageously embodiment, the nucleic acid molecule does not encode a polypeptide of the sequence as depicted in SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44 or SEQ ID NO: 46.

Unless otherwise specified, the terms "polynucleotides", "nucleic acid" and "nucleic acid molecule" are interchangeably in the present context. Unless otherwise specified, the terms "peptide", "polypeptide" and "protein" are interchangeably in the present context. The term "sequence" may relate to polynucleotides, nucleic acids, nucleic acid molecules, peptides, polypeptides and proteins, depending on the context in which the term "sequence" is used. The terms "gene(s)", "polynucleotide", "nucleic acid sequence", "nucleotide sequence", or "nucleic acid molecule(s)" as used herein refers to a polymeric form of nucleotides of any length, either ribonucleotides or deoxyribonucleotides. The terms refer only to the primary structure of the molecule.

Thus, the terms "gene(s)", "polynucleotide", "nucleic acid sequence", "nucleotide sequence", or "nucleic acid molecule(s)" as used herein include double- and single-stranded DNA and RNA. They also include known types of modifications, for example, methylation, "caps", substitutions of one or more of the naturally occurring nucleotides with an analog. Preferably, the DNA or RNA sequence of the invention comprises a coding sequence encoding the herein defined polypeptide.

A "coding sequence" is a nucleotide sequence, which is transcribed into mRNA and/or translated into a polypeptide when placed under the control of appropriate regulatory sequences. The boundaries of the coding sequence are determined by a translation start codon at the 5'-terminus and a translation stop codon at the 3'-terminus. A coding sequence can include, but is not limited to mRNA, cDNA, recombinant nucleotide sequences or genomic DNA, while introns may be present as well under certain circumstances.

Nucleic acid molecules with the sequence as depicted in SEQ ID NO: 1, SEQ ID NO: 3, SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41 SEQ ID NO: 43 or SEQ ID NO: 45, nucleic acid molecules which are derived from the amino acid sequences as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44 or SEQ ID NO: 46 or from polypeptides comprising the consensus sequence as depicted in SEQ ID NO: 47, SEQ ID NO: 48, SEQ ID NO: 49, SEQ ID NO: 50, SEQ ID NO: 51, SEQ ID NO: 52, SEQ ID NO: 397, SEQ ID NO: 398, SEQ ID NO: 399 and/or SEQ ID NO: 400, or their derivatives or homologues encoding polypeptides with the enzymatic or biological activity of a protein as depicted in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44 or SEQ ID NO: 46 and/or conferring a fine chemical increase after increasing its expression or activity are advantageously increased in the process according to the invention.

In one embodiment, said sequences are cloned into nucleic acid constructs, either individually or in combination. These nucleic acid constructs enable an optimal synthesis of the fine chemical produced in the process according to the invention.

Nucleic acid molecules, which are advantageous for the process according to the invention and which encode polypeptides with the biological activity of the protein of the invention can be determined from generally accessible databases.

Those, which must be mentioned, in particular in this context are general gene databases such as the EMBL database (Stoesser G. et al., Nucleic Acids Res 2001, Vol. 29, 17-21), the GenBank database (Benson D. A. et al., Nucleic Acids Res 2000, Vol. 28, 15-18), or the PIR database (Barker W. C. et al., Nucleic Acids Res. 1999, Vol. 27, 39-43). It is furthermore possible to use organism-specific gene databases for determining advantageous sequences, in the case of yeast for example advantageously the SGD database (Cherry J. M. et al., Nucleic Acids Res. 1998, Vol. 26, 73-80) or the MIPS database (Mewes H. W. et al., Nucleic Acids Res. 1999, Vol. 27, 44-48), in the case of E. coli the GenProtEC database, and in the case of Arabidopsis the TAIR-database (Huala, E. et al., Nucleic Acids Res. 2001 Vol. 29(1), 102-5) or the MIPS database.

The nucleic acid molecules used in the process according to the invention take the form of isolated nucleic acid sequences, which encode polypeptides having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 and conferring the fine chemical increase.

The nucleic acid sequence(s) used in the process for the production of the fine chemical in transgenic organisms originate advantageously from an eukaryote but may also originate from a prokaryote or an archebacterium, thus it can derived from e.g. a microorganism, an animal or a plant.

For the purposes of the invention, as a rule the plural is intended to encompass the singular and vice versa.

In order to improve the introduction of the nucleic acid sequences and the expression of the sequences in the transgenic organisms, which are used in the process, the nucleic acid sequences are incorporated into a nucleic acid construct and/or a vector. In addition to the herein described sequences which are used in the process according to the invention, further nucleic acid sequences, advantageously of biosynthesis genes of amino acids, carbohydrates, lipids, fatty acids, vitamins etc. produced in the process according to the invention, may additionally be present in the nucleic acid construct or in the vector and may be introduced into the organism together. However, these additional sequences may also be introduced into the organisms via other, separate nucleic acid constructs or vectors.

Using the herein mentioned cloning vectors and transformation methods such as those which are published and cited in: Plant Molecular Biology and Biotechnology (CRC Press, Boca Raton, Fla.), chapter 6/7, pp. 71-119 (1993); F. F. White, Vectors for Gene Transfer in Higher Plants; in: Transgenic Plants, vol. 1, Engineering and Utilization, Ed.: Kung and R. Wu, Academic Press, 1993, 15-38; B. Jenes et al., Techniques for Gene Transfer, in: Transgenic Plants, vol. 1, Engineering and Utilization, Ed.: Kung and R. Wu, Academic Press (1993), 128-143; Potrykus, Annu. Rev. Plant. Physiol. Plant Molec. Biol. 42 (1991), 205-225)) and further cited below, the nucleic acids may be used for the recombinant modification of a wide range of organisms, in particular prokaryotic or eukaryotic microorganisms or plants, so that they become a better and more efficient producer of the fine chemical produced in the process according to the invention. This improved production, or production efficiency, of the fine chemical or products derived there from, such as modified proteins, can be brought about by a direct effect of the manipulation or by an indirect effect of this manipulation.

In one embodiment, the nucleic acid molecule according to the invention originates from a plant, such as a plant selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants and in particular plants mentioned herein above as host plants such as the families and genera mentioned above for example preferred the species *Anacardium occidentale, Calendula officinalis, Carthamus tinctorius, Cichorium intybus, Cynara scolymus, Helianthus annus, Tagetes lucida, Tagetes erecta, Tagetes tenuifolia; Daucus carota; Corylus avellana, Corylus colurna, Borago officinalis; Brassica napus, Brassica rapa ssp., Sinapis arvensis, Brassica juncea, Brassica juncea var. juncea, Brassica juncea var. crispifolia, Brassica juncea var. foliosa, Brassica nigra, Brassica sinapioides, Melanosinapis communis, Brassica oleracea, Arabidopsis thaliana, Anana comosus, Ananas ananas, Bromelia comosa, Carica papaya, Cannabis sative, Ipomoea batatus, Ipomoea pandurata, Convolvulus batatas, Convolvulus tiliaceus, Ipomoea fastigiata, Ipomoea tiliacea, Ipomoea triloba, Convolvulus panduratus, Beta vulgaris, Beta vulgaris var. altissima, Beta vulgaris var. vulgaris, Beta maritima, Beta vulgaris var. perennis, Beta vulgaris var. conditiva, Beta vulgaris var. esculenta, Cucurbita maxima, Cucurbita mixta, Cucurbita pepo, Cucurbita moschata, Olea europaea, Manihot utilissima, Janipha manihot, Jatropha manihot, Manihot aipil, Manihot dulcis, Manihot manihot, Manihot melanobasis, Manihot esculenta, Ricinus communis, Pisum sativum, Pisum arvense, Pisum humile, Medicago sativa, Medicago falcata, Medicago varia, Glycine max Dolichos soja, Glycine gracilis, Glycine hispida, Phaseolus max, Soja hispida, Soja max, Cocos nucifera, Pelargonium grossularioides, Oleum cocoas, Laurus nobilis, Persea americana, Arachis hypogaea, Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne var. lewisii, Linum pratense, Linum trigynum, Punica granatum, Gossypium hirsutum, Gossypium arboreum, Gossypium barbadense, Gossypium herbaceum, Gossypium thurberi, Musa nana, Musa acuminata, Musa paradisiaca, Musa spp., Elaeis guineensis, Papaver orientale, Papaver rhoeas, Papaver dubium, Sesamum indicum, Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata, Hordeum vulgare, Hordeum jubatum, Hordeum murinum, Hordeum secalinum, Hordeum distichon, Hordeum aegiceras, Hordeum hexastichon, Hordeum hexastichum, Hordeum irregulare, Hordeum sativum, Hordeum secalinum, Avena sativa, Avena fatua, Avena byzantina, Avena fatua var. sativa, Avena hybrida, Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum, Zea mays, Triticum aestivum, Triticum durum, Triticum turgidum, Triticum hybernum, Triticum macha, Triticum sativum or Triticum vulgare, Cofea spp., Coffea arabica, Coffea canephora, Coffea liberica, Capsicum annuum, Capsicum annuum var. glabriusculum, Capsicum frutescens, Capsicum annuum, Nicotiana tabacum, Solanum tuberosum, Solanum melongena, Lycopersicon esculentum, Lycopersicon lycopersicum, Lycopersicon pyriforme, Solanum integrifolium, Solanum lycopersicum Theobroma cacao* or *Camellia sinensis*.

In one embodiment, the nucleic acid molecule sequence originates advantageously from a microorganism as mentioned above under host organism such as a fungus for example the genera *Aspergillus, Penicillium* or *Claviceps* or from yeasts such as the genera *Pichia, Torulopsis, Hansenula, Schizosaccharomyces, Candida, Rhodotorula* or *Saccharomyces*, very especially advantageously from the yeast of the family Saccharomycetaceae, such as the advantageous genus *Saccharomyces* and the very advantageous genus and species *Saccharomyces cerevisiae* for the production of the fine chemical in microorganims.

The skilled worker knows other suitable sources for the production of fine chemicals, which present also useful nucleic acid molecule sources. They include in general all prokaryotic or eukaryotic cells, preferably unicellular microorganisms, such as fungi like the genus *Claviceps* or *Aspergillus* or gram-positive bacteria such as the genera *Bacillus, Corynebacterium, Micrococcus, Brevibacterium, Rhodococ-* cus, *Nocardia, Caseobacter* or *Arthrobacter* or gram-negative bacteria such as the genera *Escherichia, Flavobacterium* or *Salmonella*, or yeasts such as the genera *Rhodotorula, Hansenula* or *Candida*.

Production strains which are especially advantageously selected in the process according to the invention are microorganisms selected from the group of the families Actinomycetaceae, Bacillaceae, Brevibacteriaceae, Corynebacteriaceae, Enterobacteriacae, Gordoniaceae, Micrococcaceae, Mycobacteriaceae, Nocardiaceae, Pseudomonaceae, Rhizobiaceae, Streptomycetaceae, Chaetomiaceae, Choanephoraceae, Cryptococcaceae, Cunninghamellaceae, Demetiaceae, Moniliaceae, Mortierellaceae, Mucoraceae, Pythiaceae, Saccharomycetaceae, Saprolegniaceae, Schizosaccharomycetaceae, Sodariaceae, Sporobolomycetaceae, Tuberculariaceae, Adelotheciaceae, Dinophyceae, Ditrichaceae and Prasinophyceaeor of the genera and species consisting of *Hansenula anomala, Candida utilis, Claviceps purpurea, Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium acetoglutamicum, Corynebacterium ammoniagenes, Corynebacterium glutamicum* (=*Micrococcus glutamicum*), *Corynebacterium melassecola, Corynebacterium* sp. or *Escherichia coli*, specifically *Escherichia coli* K12 and its described strains.

However, it is also possible to use artificial sequences, which differ in one or more bases (=nucleotides) from the nucleic acid sequences found in organisms, or in one or more amino acid molecules from polypeptide sequences found in organisms, in particular from the polypeptide sequences as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or the functional homologues thereof as described herein, preferably conferring above-mentioned biological activity, i.e. conferring the fine chemical increase after increasing its activity, e.g. having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394.

In the process according to the invention nucleic acid sequences can be used, which, if appropriate, contain synthetic, non-natural or modified nucleotide bases, which can be incorporated into DNA or RNA. Said synthetic, non-natural or modified bases can for example increase the stability of the nucleic acid molecule outside or inside a cell. The nucleic acid molecules of the invention can contain the same modifications as aforementioned.

As used in the present context the term "nucleic acid molecule" may also encompass the untranslated sequence located at the 3' and at the 5' end of the coding gene region, for example at least 500, preferably 200, especially preferably 100, nucleotides of the sequence upstream of the 5' end of the coding region and at least 100, preferably 50, especially preferably 20, nucleotides of the sequence downstream of the 3' end of the coding gene region. It is often advantageous only to choose the coding region for cloning and expression purposes.

Preferably, the nucleic acid molecule used in the process according to the invention or the nucleic acid molecule of the invention is an isolated nucleic acid molecule.

An "isolated" polynucleotide or nucleic acid molecule is separated from other polynucleotides or nucleic acid molecules, which are present in the natural source of the nucleic acid molecule. An isolated nucleic acid molecule may be a chromosomal fragment of several kb, or preferably, a molecule only comprising the coding region of the gene. Accordingly, an isolated nucleic acid molecule of the invention may comprise chromosomal regions, which are adjacent 5' and 3' or further adjacent chromosomal regions, but preferably comprises no such sequences which naturally flank the nucleic acid molecule sequence in the genomic or chromosomal context in the organism from which the nucleic acid molecule originates (for example sequences which are adjacent to the regions encoding the 5'- and 3'-UTRs of the nucleic acid molecule). In various embodiments, the isolated nucleic acid molecule used in the process according to the invention may, for example comprise less than approximately 5 kb, 4 kb, 3 kb, 2 kb, 1 kb, 0.5 kb or 0.1 kb nucleotide sequences which naturally flank the nucleic acid molecule in the genomic DNA of the cell from which the nucleic acid molecule originates.

The nucleic acid molecules used in the process, for example the polynucleotides of the invention or of a part thereof can be isolated using molecular-biological standard techniques and the sequence information provided herein. Also, for example a homologous sequence or homologous, conserved sequence regions at the DNA or amino acid level can be identified with the aid of comparison algorithms. The former can be used as hybridization probes under standard hybridization techniques (for example those described in Sambrook et al., Molecular Cloning: A Laboratory Manual. 2nd Ed., Cold Spring Harbor Laboratory, Cold Spring Harbor Laboratory Press, Cold Spring Harbor, N.Y., 1989) for isolating further nucleic acid sequences useful in this process.

A nucleic acid molecule encompassing a complete sequence of the nucleic acid molecules used in the process, for example the polynucleotide of the invention, or a part thereof may additionally be isolated by polymerase chain reaction, oligonucleotide primers based on this sequence or on parts thereof being used. For example, a nucleic acid molecule comprising the complete sequence or part thereof can be isolated by polymerase chain reaction using oligonucleotide primers which have been generated on the basis of this sequence for example, mRNA can be isolated from cells (for example by means of the guanidinium thiocyanate extraction method of Chirgwin et al. (1979) Biochemistry 18:5294-5299) and cDNA can be generated by means of reverse transcriptase (for example Moloney MLV reverse transcriptase, available from Gibco/BRL, Bethesda, Md., or AMV reverse transcriptase, obtainable from Seikagaku America, Inc., St. Petersburg, Fla.).

Synthetic oligonucleotide primers for the amplification, e.g. as shown in SEQ ID NO: 53, SEQ ID NO: 54, SEQ ID NO: 395 or SEQ ID NO: 396, by means of polymerase chain reaction can be generated on the basis of a sequence shown herein, for example the sequence as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved regions are those, which show a very little variation in the amino acid in one particular position of several homologs from different origin. The consensus sequences as depicted in SEQ ID NO: 47, SEQ ID NO: 48, SEQ ID NO: 49, SEQ ID NO: 50, SEQ ID NO: 51, SEQ ID NO: 52, SEQ ID NO: 397, SEQ ID NO: 398, SEQ ID NO: 399 and/or SEQ ID NO: 400 are derived from said alignments.

Degenerated primers can then be utilized by PCR for the amplification of fragments of novel proteins having above-mentioned activity, e.g. conferring the increase of the fine chemical after increasing the expression or activity or having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or further functional homologs of the polypeptide of the invention from other organisms.

These fragments can then be utilized as hybridization probe for isolating the complete gene sequence. As an alternative, the missing 5' and 3' sequences can be isolated by means of RACE-PCR (rapid amplification of cDNA ends). A nucleic acid molecule according to the invention can be amplified using cDNA or, as an alternative, genomic DNA as template and suitable oligonucleotide primers, following standard PCR amplification techniques. The nucleic acid molecule amplified thus can be cloned into a suitable vector and characterized by means of DNA sequence analysis. Oligonucleotides, which correspond to one of the nucleic acid molecules used in the process can be generated by standard synthesis methods, for example using an automatic DNA synthesizer.

Nucleic acid molecules which are advantageously for the process according to the invention can be isolated based on their homology to the nucleic acid molecules disclosed herein using the sequences or part thereof as hybridization probe and following standard hybridization techniques under stringent hybridization conditions. In this context, it is possible to use, for example, isolated nucleic acid molecules of at least 15, 20, 25, 30, 35, 40, 50, 60 or more nucleotides, preferably of at least 15, 20 or 25 nucleotides in length which hybridize under stringent conditions with the above-described nucleic acid molecules, in particular with those which encompass a nucleotide sequence of the nucleic acid molecule used in the process of the invention or encoding a protein used in the invention or of the nucleic acid molecule of the invention. Nucleic acid molecules with 30, 50, 100, 250 or more nucleotides may also be used.

The term "homology" means that the respective nucleic acid molecules or encoded proteins are functionally and/or structurally equivalent. The nucleic acid molecules that are homologous to the nucleic acid molecules described above and that are derivatives of said nucleic acid molecules are, for example, variations of said nucleic acid molecules which represent modifications having the same biological function, in particular encoding proteins with the same or substantially the same biological function. They may be naturally occurring variations, such as sequences from other plant varieties or species, or mutations. These mutations may occur naturally or may be obtained by mutagenesis techniques. The allelic variations may be naturally occurring allelic variants as well as synthetically produced or genetically engineered variants. Structurally equivalents can, for example, be identified by testing the binding of said polypeptide to antibodies or computer based predictions. Structurally equivalent have the similar immunological characteristic, e.g. comprise similar epitopes.

By "hybridizing" it is meant that such nucleic acid molecules hybridize under conventional hybridization conditions, preferably under stringent conditions such as described by, e.g., Sambrook (Molecular Cloning; A Laboratory Manual, 2nd Edition, Cold Spring Harbor Laboratory Press, Cold Spring Harbor, N.Y. (1989)) or in Current Protocols in Molecular Biology, John Wiley & Sons, N.Y. (1989), 6.3.1-6.3.6.

According to the invention, DNA as well as RNA molecules of the nucleic acid of the invention can be used as probes. Further, as template for the identification of functional homologues Northern blot assays as well as Southern blot assays can be performed. The Northern blot assay advantageously provides further informations about the expressed gene product: e.g. expression pattern, occurance of processing steps, like splicing and capping, etc. The Southern blot assay provides additional information about the chromosomal localization and organization of the gene encoding the nucleic acid molecule of the invention.

A preferred, nonlimiting example of stringent hydridization conditions are hybridizations in 6× sodium chloride/sodium citrate (=SSC) at approximately 45° C., followed by one or more wash steps in 0.2×SSC, 0.1% SDS at 50 to 65° C., for example at 50° C., 55° C. or 60° C. The skilled worker knows that these hybridization conditions differ as a function of the type of the nucleic acid and, for example when organic solvents are present, with regard to the temperature and concentration of the buffer. The temperature under "standard hybridization conditions" differs for example as a function of the type of the nucleic acid between 42° C. and 58° C., preferably between 45° C. and 50° C. in an aqueous buffer with a concentration of 0.1×0.5×, 1×, 2×, 3×, 4× or 5×SSC (pH 7.2). If organic solvent(s) is/are present in the abovementioned buffer, for example 50% formamide, the temperature under standard conditions is approximately 40° C., 42° C. or 45° C. The hybridization conditions for DNA:DNA hybrids are preferably for example 0.1×SSC and 20° C., 25° C., 30° C., 35° C., 40° C. or 45° C., preferably between 30° C. and 45° C. The hybridization conditions for DNA:RNA hybrids are preferably for example 0.1×SSC and 30° C., 35° C., 40° C., 45° C., 50° C. or 55° C., preferably between 45° C. and 55° C. The abovementioned hybridization temperatures are determined for example for a nucleic acid approximately 100 bp (=base pairs) in length and a G+C content of 50% in the absence of formamide. The skilled worker knows to determine the hybridization conditions required with the aid of textbooks, for example the ones mentioned above, or from the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford.

A further example of one such stringent hybridization condition is hybridization at 4×SSC at 65° C., followed by a washing in 0.1×SSC at 65° C. for one hour. Alternatively, an exemplary stringent hybridization condition is in 50% formamide, 4×SSC at 42° C. Further, the conditions during the wash step can be selected from the range of conditions delimited by low-stringency conditions (approximately 2×SSC at 50° C.) and high-stringency conditions (approximately 0.2× SSC at 50° C., preferably at 65° C.) (20×SSC: 0.3M sodium citrate, 3M NaCl, pH 7.0). In addition, the temperature during the wash step can be raised from low-stringency conditions at room temperature, approximately 22° C., to higher-stringency conditions at approximately 65° C. Both of the parameters salt concentration and temperature can be varied simultaneously, or else one of the two parameters can be kept constant while only the other is varied. Denaturants, for example formamide or SDS, may also be employed during the hybridization. In the presence of 50% formamide, hybridization is preferably effected at 42° C. Relevant factors like i) length of treatment, ii) salt conditions, iii) detergent conditions, iv) competitor DNAs, v) temperature and vi) probe selection can be combined case by case so that not all possibilities can be mentioned herein.

Thus, in a preferred embodiment, Northern blots are prehybridized with Rothi-Hybri-Quick buffer (Roth, Karlsruhe) at 68° C. for 2 h. Hybridzation with radioactive labelled probe is done overnight at 68° C. Subsequent washing steps are performed at 68° C. with 1×SSC.

For Southern blot assays the membrane is prehybridized with Rothi-Hybri-Quick buffer (Roth, Karlsruhe) at 68° C. for 2 h. The hybridzation with radioactive labelled probe is conducted over night at 68° C. Subsequently the hybridization buffer is discarded and the filter shortly washed using 2×SSC; 0.1% SDS. After discarding the washing buffer new 2×SSC; 0.1% SDS buffer is added and incubated at 68° C. for 15 minutes. This washing step is performed twice followed by an additional washing step using 1×SSC; 0.1% SDS at 68° C. for 10 min.

Some further examples of conditions for DNA hybridization (Southern blot assays) and wash step are shown hereinbelow:

(1) Hybridization conditions can be selected, for example, from the following conditions:
 a) 4×SSC at 65° C.,
 b) 6×SSC at 45° C.,
 c) 6×SSC, 100 mg/ml denatured fragmented fish sperm DNA at 68° C.,
 d) 6×SSC, 0.5% SDS, 100 mg/ml denatured salmon sperm DNA at 68° C.,
 e) 6×SSC, 0.5% SDS, 100 mg/ml denatured fragmented salmon sperm DNA, 50% formamide at 42° C.,
 f) 50% formamide, 4×SSC at 42° C.,
 g) 50% (vol/vol) formamide, 0.1% bovine serum albumin, 0.1% Ficoll, 0.1% polyvinylpyrrolidone, 50 mM sodium phosphate buffer pH 6.5, 750 mM NaCl, 75 mM sodium citrate at 42° C.,
 h) 2× or 4×SSC at 50° C. (low-stringency condition), or
 i) 30 to 40% formamide, 2× or 4×SSC at 42° C. (low-stringency condition).

(2) Wash steps can be selected, for example, from the following conditions:
 a) 0.015 M NaCl/0.0015 M sodium citrate/0.1% SDS at 50° C.
 b) 0.1×SSC at 65° C.
 c) 0.1×SSC, 0.5% SDS at 68° C.
 d) 0.1×SSC, 0.5% SDS, 50% formamide at 42° C.
 e) 0.2×SSC, 0.1% SDS at 42° C.
 f) 2×SSC at 65° C. (low-stringency condition).

Polypeptides having above-mentioned biological activity, i.e. conferring the fine chemical increase, derived from other organisms, can be encoded by other DNA sequences which hybridize to the sequences shown in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 under relaxed hybridization conditions and which code on expression for peptides having the fine chemical increasing activity.

Further, some applications have to be performed at low stringency hybridisation conditions, without any consequences for the specificity of the hybridisation. For example, a Southern blot analysis of total DNA could be probed with a nucleic acid molecule of the present invention and washed at low stringency (55° C. in 2×SSPE0, 1% SDS). The hybridisation analysis could reveal a simple pattern of only genes encoding polypeptides of the present invention or used in the process of the invention, e.g. having herein-mentioned activity of increasing the fine chemical. A further example of such low-stringent hybridization conditions is 4×SSC at 50° C. or hybridization with 30 to 40% formamide at 42° C. Such molecules comprise those which are fragments, analogues or derivatives of the polypeptide of the invention or used in the process of the invention and differ, for example, by way of amino acid and/or nucleotide deletion(s), insertion(s), substitution(s), addition(s) and/or recombination(s) or any other modification(s) known in the art either alone or in combination from the above-described amino acid sequences or their underlying nucleotide sequence(s). However, it is preferred to use high stringency hybridisation conditions.

Hybridization should advantageously be carried out with fragments of at least 5, 10, 15, 20, 25, 30, 35 or 40 bp, advantageously at least 50, 60, 70 or 80 bp, preferably at least 90, 100 or 110 bp. Most preferably are fragments of at least 15, 20, 25 or 30 bp. Preferably are also hybridizations with at least 100 bp or 200, very especially preferably at least 400 bp in length. In an especially preferred embodiment, the hybridization should be carried out with the entire nucleic acid sequence with conditions described above.

The terms "fragment", "fragment of a sequence" or "part of a sequence" mean a truncated sequence of the original sequence referred to. The truncated sequence (nucleic acid or protein sequence) can vary widely in length; the minimum size being a sequence of sufficient size to provide a sequence with at least a comparable function and/or biological activity of the original sequence referred to or hybidizing with the nucleic acid molecule of the invention or used in the process of the invention under stringend conditions, while the maximum size is not critical. In some applications, the maximum size usually is not substantially greater than that required to provide the desired activity and/or function(s) of the original sequence.

Typically, the truncated amino acid sequence will range from about 5 to about 260 amino acids in length. More typically, however, the sequence will be a maximum of about 220 amino acids in length, preferably a maximum of about 215 or 100 amino acids. It is usually desirable to select sequences of at least about 100, 120 or 150 amino acids, up to a maximum of about 200 or 250 amino acids.

The term "epitope" relates to specific immunoreactive sites within an antigen, also known as antigenic determinates. These epitopes can be a linear array of monomers in a polymeric composition—such as amino acids in a protein—or consist of or comprise a more complex secondary or tertiary structure. Those of skill will recognize that immunogens (i.e., substances capable of eliciting an immune response) are antigens; however, some antigen, such as haptens, are not immunogens but may be made immunogenic by coupling to a carrier molecule. The term "antigen" includes references to a substance to which an antibody can be generated and/or to which the antibody is specifically immunoreactive.

In one embodiment the present invention relates to a epitope of the polypeptide of the present invention or used in the process of the present invention and conferring above mentioned biological activity, preferably conferring an increase in the fine chemical.

The term "one or several amino acids" relates to at least one amino acid but not more than that number of amino acids, which would result in a homology of below 50% identity. Preferably, the identity is more than 70% or 80%, more preferred are 85%, 90%, 91%, 92%, 93%, 94% or 95%, even more preferred are 96%, 97%, 98%, or 99% identity.

Further, the nucleic acid molecule of the invention comprises a nucleic acid molecule, which is a complement of one of the nucleotide sequences of above mentioned nucleic acid molecules or a portion thereof. A nucleic acid molecule which is complementary to one of the nucleotide sequences as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 is one which is sufficiently complementary to one of the nucleotide sequences as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 such that it can hybridize to one of the nucleotide sequences as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393, thereby forming a stable duplex. Preferably, the hybridisation is performed under stringent hybrization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% most preferably at least about 99.1%; 99.2%, 99.3%; 99.4%; 99.5%; 99.6%; 99.7%; 99.8% or 99.9% or more homologous to a nucleotide sequence as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393, or a portion thereof and preferably has above mentioned biological activity, in particular having a fine chemical increasing activity after increasing the biological acitivity of a protein having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258., 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 and their respective gene products.

The nucleic acid molecule of the invention comprises a nucleotide sequence which hybridizes, preferably hybridizes under stringent conditions as defined herein, to one of the nucleotide sequences as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393, or a portion thereof and encodes a protein having above-mentioned biological activity, e.g. conferring the fine chemical increase, and optionally, having the biological activity of YNL090W.

Moreover, the nucleic acid molecule of the invention can comprise only a portion of the coding region of one of the sequences in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393, for example a fragment which can be used as a probe or primer or a fragment encoding a biologically active portion of the polypeptide of the present invention or of a polypeptide used in the process of the present invention, i.e. having above-mentioned activity, e.g. conferring an increase of methionine if its activity is increased. The nucleotide sequences determined from the cloning of the present protein according to the invention encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393, an anti-sense sequence of one of the sequences, e.g., set forth in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in SEQ ID NO: 53, SEQ ID NO: 54, SEQ ID NO: 395 or SEQ ID NO: 396 will at least result in a fragment of gene products as depicted in the sequences SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393.

Primer sets are interchangable. The person skilled in the art knows to combine said primers to result in the desired product, e.g. in a full-length clone or a partial sequence. Probes based on the sequences of the nucleic acid molecule of the invention or used in the process of the present invention can be used to detect transcripts or genomic sequences encoding the same or homologous proteins. The probe can further comprise a label group attached thereto, e.g. the label group can be a radioisotope, a fluorescent compound, an enzyme, or an enzyme co-factor. Such probes can be used as a part of a genomic marker test kit for identifying cells which express an polypepetide of the invention or used in the process of the present invention, such as by measuring a level of an encoding nucleic acid molecule in a sample of cells, e.g., detecting mRNA levels or determining, whether a genomic gene comprising the sequence of the polynucleotide of the invention or used in the processs of the present invention has been mutated or deleted.

The nucleic acid molecule of the invention encodes a polypeptide or portion thereof which includes an amino acid sequence which is sufficiently homologous to the amino acid sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 such that the protein or portion thereof maintains the ability to participate in the fine chemical production, in particular an amino acid increasing activity as mentioned above or as described in the examples in plants or microorganisms is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 are described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 and having above-mentioned activity, e.g. conferring preferably the increase of the fine chemical.

Portions of proteins encoded by the nucleic acid molecule of the invention are preferably biologically active, preferably having above-mentioned annotated activity, e.g. conferring an increase of the fine chemical after increase of activity.

As mentioned herein, the term "biologically active portion" is intended to include a portion, e.g., a domain/motif, that confers increase of the fine chemical or has an immunological activity such that it is binds to an antibody binding specifially to the polypeptide of the present invention or a polypeptide used in the process of the present invention for producing the fine chemical;

The invention further relates to nucleic acid molecules that differ from one of the nucleotide sequences as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 (and portions thereof) due to degeneracy of the genetic code and thus encode a polypeptide of the present invention, in particular a polypeptide having above mentioned activity, e.g. conferring an increase in the fine chemical in a organism. Advantageously, the nucleic acid molecule of the invention comprises, or in an other embodiment has, a nucleotide sequence encoding a protein comprising, or in an other embodiment having, an amino acid sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or the functional homologues. In a still further embodiment, the nucleic acid molecule of the invention encodes a full length protein which is substantially homologous to an amino acid sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or the functional homologues. However, in a preferred embodiment, the nucleic acid molecule of the present invention does not consist of the sequence as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393.

In addition, it will be appreciated by those skilled in the art that DNA sequence polymorphisms that lead to changes in the amino acid sequences may exist within a population. Such genetic polymorphism in the gene encoding the polypeptide of the invention or comprising the nucleic acid molecule of the invention may exist among individuals within a population due to natural variation.

As used herein, the terms "gene" and "recombinant gene" refer to nucleic acid molecules comprising an open reading frame encoding the polypeptide of the invention or comprising the nucleic acid molecule of the invention or encoding the polypeptide used in the process of the present invention, preferably from a crop plant or from a microorganism useful for the production of fine chemicals, in particular for the production of the fine chemical. Such natural variations can typically result in 1-5% variance in the nucleotide sequence of the gene. Any and all such nucleotide variations and resulting amino acid polymorphisms in genes encoding a polypeptide of the invention or comprising a the nucleic acid molecule of the invention that are the result of natural variation and that do not alter the functional activity as described are intended to be within the scope of the invention.

Nucleic acid molecules corresponding to natural variants homologues of a nucleic acid molecule of the invention, which can also be a cDNA, can be isolated based on their homology to the nucleic acid molecules disclosed herein using the nucleic acid molecule of the invention, or a portion thereof, as a hybridization probe according to standard hybridization techniques under stringent hybridization conditions.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393. The nucleic acid molecule is preferably at least 20, 30, 50, 100, 250 or more nucleotides in length.

The term "hybridizes under stringent conditions" is defined above. In one embodiment, the term "hybridizes under stringent conditions" is intended to describe conditions for hybridization and washing under which nucleotide sequences at least 30%, 40%, 50% or 65% identical to each other typically remain hybridized to each other. Preferably, the conditions are such that sequences at least about 70%, more preferably at least about 75% or 80%, and even more preferably at least about 85%, 90% or 95% or more identical to each other typically remain hybridized to each other.

Preferably, nucleic acid molecule of the invention that hybridizes under stringent conditions to a sequence as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring the fine chemical increase after increasing the expression or activity thereof or the activity of a protein of the invention or used in the process of the invention.

In addition to naturally-occurring variants of the sequences of the polypeptide or nucleic acid molecule of the invention as well as of the polypeptide or nucleic acid molecule used in the process of the invention that may exist in the population, the skilled artisan will further appreciate that changes can be introduced by mutation into a nucleotide sequence of the nucleic acid molecule encoding the polypeptide of the invention or used in the process of the present invention, thereby leading to changes in the amino acid sequence of the encoded polypeptide, without altering the functional ability of the polypeptide, preferably not decreasing said activity.

For example, nucleotide substitutions leading to amino acid substitutions at "non-essential" amino acid residues can be made in a sequence of the nucleic acid molecule of the invention or used in the process of the invention, e.g. in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393.

A "non-essential" amino acid residue is a residue that can be altered from the wild-type sequence of one without altering the activity of said polypeptide, whereas an "essential" amino acid residue is required for an activity as mentioned above, e.g. leading to an increase in the fine chemical in an organism after an increase of activity of the polypeptide. Other amino acid residues, however, (e.g., those that are not conserved or only semi-conserved in the domain having said activity) may not be essential for activity and thus are likely to be amenable to alteration without altering said activity.

Further, a person skilled in the art knows that the codon usage between organisms can differ. Therefore, he may adapt the codon usage in the nucleic acid molecule of the present invention to the usage of the organism in which the polynucleotide or polypeptide is expressed.

Accordingly, the invention relates to nucleic acid molecules encoding a polypeptide having above-mentioned biological activity, e.g. conferring an increase in the the fine chemical in an organism or part thereof that contain changes in amino acid residues that are not essential for said activity. Such polypeptides differ in amino acid sequence from a sequence contained in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 yet retain said activity described herein. The nucleic acid molecule can comprise a nucleotide sequence encoding a polypeptide, wherein the polypeptide comprises an amino acid sequence at least about 50% identical to an amino acid sequence of SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 and is capable of participation in the increase of production of the fine chemical after increasing its activity, e.g. its expression. Preferably, the protein encoded by the nucleic acid molecule is at least about 60% identical to the sequence in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394, more preferably at least about 70% identical to one of the sequences in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394, even more preferably at least about 80%, 90%, 95% homologous to the sequence in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394, and most preferably at least about 96%, 97%, 98%, or 99% identical to the sequence in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394.

To determine the percentage homology (=identity) of two amino acid sequences or of two nucleic acid molecules, the sequences are written one underneath the other for an optimal comparison (for example gaps may be inserted into the sequence of a protein or of a nucleic acid in order to generate an optimal alignment with the other protein or the other nucleic acid).

The amino acid residues or nucleic acid molecules at the corresponding amino acid positions or nucleotide positions are then compared. If a position in one sequence is occupied by the same amino acid residue or the same nucleic acid molecule as the corresponding position in the other sequence, the molecules are homologous at this position (i.e. amino acid or nucleic acid "homology" as used in the present context corresponds to amino acid or nucleic acid "identity". The percentage homology between the two sequences is a function of the number of identical positions shared by the sequences (i.e. % homology=number of identical positions/total number of positions×100). The terms "homology" and "identity" are thus to be considered as synonyms.

For the determination of the percentage homology (=identity) of two or more amino acids or of two or more nucleotide sequences several computer software programs have been developed. The homology of two or more sequences can be calculated with for example the software fasta, which presently has been used in the version fasta 3 (W. R. Pearson and D. J. Lipman (1988), Improved Tools for Biological Sequence Comparison. PNAS 85:2444-2448; W. R. Pearson (1990) Rapid and Sensitive Sequence Comparison with FASTP and FASTA, Methods in Enzymology 183:63-98; W. R. Pearson and D. J. Lipman (1988) Improved Tools for Biological Sequence Comparison. PNAS 85:2444-2448; W. R. Pearson (1990); Rapid and Sensitive Sequence Comparison with FASTP and FASTA Methods in Enzymology 183: 63-98). Another useful program for the calculation of homologies of different sequences is the standard blast program, which is included in the Biomax pedant software (Biomax, Munich, Federal Republic of Germany). This leads unfortunately sometimes to suboptimal results since blast does not always include complete sequences of the subject and the querry. Nevertheless as this program is very efficient it can be used for the comparison of a huge number of sequences. The following settings are typically used for such a comparisons of sequences:

-p Program Name [String]; -d Database [String]; default=nr; -i Query File [File In]; default=stdin; -e Expectation value (E) [Real]; default=10.0; -m alignment view options: 0=pairwise; 1=query-anchored showing identities; 2=query-anchored no identities; 3=flat query-anchored, show identities; 4=flat query-anchored, no identities; 5=query-anchored no identities and blunt ends; 6=flat query-anchored, no identities and blunt ends; 7=XML Blast output; 8=tabular; 9 tabular with comment lines [Integer]; default=0; -o BLAST report Output File [File Out] Optional; default=stdout; -F Filter query sequence (DUST with blastn, SEG with others) [String]; default=T; -G Cost to open a gap (zero invokes default behavior) [Integer]; default=0; -E Cost to extend a gap (zero invokes default behavior) [Integer]; default=0; -X X dropoff value for gapped alignment (in bits) (zero invokes default behavior); blastn 30, megablast 20, tblastx 0, all others 15 [Integer]; default=0; -I Show GI's in deflines [T/F]; default=F; -q Penalty for a nucleotide mismatch (blastn only) [Integer]; default=-3; -r Reward for a nucleotide match (blastn only) [Integer]; default=1; -v Number of database sequences to show one-line descriptions for (V) [Integer]; default=500; -b Number of database sequence to show alignments for (B) [Integer]; default=250; -f Threshold for extending hits, default if zero; blastp 11, blastn 0, blastx 12, tblastn 13; tblastx 13, megablast 0 [Integer]; default=0; -g Perform gapped alignment (not available with tblastx) [T/F]; default=T; -Q Query Genetic code to use [Integer]; default=1; -D DB Genetic code (for tblast[nx] only) [Integer]; default=1; -a Number of processors to use [Integer]; default=1; -O SeqAlign file [File Out] Optional; -J Believe the query defline [T/F]; default=F; -M Matrix [String]; default=BLOSUM62; -W Word size, default if zero (blastn 11, megablast 28, all others 3) [Integer]; default=0; -z Effective length of the database (use zero for the real size) [Real]; default=0; -K Number of best hits from a region to keep (off by default, if used a value of 100 is recommended) [Integer]; default=0; -P 0 for multiple hit, 1 for single hit [Integer]; default=0; -Y Effective length of the search space (use zero for the real size) [Real]; default=0; -S Query strands to search against database (for blast[nx], and tblastx); 3 is both, 1 is top, 2 is bottom [Integer]; default=3; -T Produce HTML output [T/F]; default=F; -I Restrict search of database to list of GI's [String] Optional; -U Use lower case filtering of FASTA sequence [T/F] Optional; default=F; -y X dropoff value for ungapped extensions in bits (0.0 invokes default behavior); blastn 20, megablast 10, all others 7 [Real]; default=0.0; -Z X dropoff value for final gapped alignment in bits (0.0 invokes default behavior); blastn/megablast 50, tblastx 0, all others 25 [Integer]; default=0; -R PSI-TBLASTN checkpoint file [File In] Optional; -n MegaBlast search [T/F]; default=F; -L Location on query sequence [String] Optional; -A Multiple Hits window size, default if zero (blastn/megablast 0, all others 40 [Integer]; default=0; -w Frame shift penalty (OOF algorithm for blastx) [Integer]; default=0; -t Length of the largest intron allowed in tblastn for linking HSPs (0 disables linking) [Integer]; default=0.

Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the perentages of sequence homology are done with the program Gap over the whole range of the sequences. The following standard adjustments for the comparison of nucleic acid sequences were used: gap weight: 50, length weight: 3, average match: 10.000, average mismatch: 0.000.

For example a sequence which has a 80% homology with sequence SEQ ID NO: 1 at the nucleic acid level is understood as meaning a sequence which, upon comparison with the sequence SEQ ID NO: 1 by the above Gap program algorithm with the above parameter set, has a 80% homology.

In the state of the art, homology between two polypeptides is also understood as meaning the identity of the amino acid sequence over in each case the entire sequence length which is calculated by comparison with the aid of the program algorithm GAP (Wisconsin Package Version 10.0, University of Wisconsin, Genetics Computer Group (GCG), Madison, USA), setting the following parameters:

| Gap weight: | 8 | Length weight: | 2 |
| Average match: | 2,912 | Average mismatch: | −2,003 |

For example a sequence which has a 80% homology with sequence SEQ ID NO: 2 at the protein level is understood as meaning a sequence which, upon comparison with the sequence SEQ ID NO: 2 by the above program algorithm with the above parameter set, has a 80% homology.

Functional equivalents derived from one of the polypeptides as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 according to the invention and are distinguished by essentially the same properties as the polypeptide as shown in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394.

Functional equivalents derived from the nucleic acid sequence as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 according to the invention and encode polypeptides having essentially the same properties as the polypeptide as shown in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394.

"Essentially the same properties" of a functional equivalent is above all understood as meaning that the functional equivalent has above mentioned acitivty, e.g conferring an increase in the fine chemical amount while increasing the amount of protein, activity or function of said functional equivalent in an organism, e.g. a microorgansim, a plant or plant or animal tissue, plant or animal cells or a part of the same.

A nucleic acid molecule encoding an homologous to a protein sequence of SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 can be created by introducing one or more nucleotide substitutions, additions or deletions into a nucleotide sequence of the nucleic acid molecule of the present invention, in particular of SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 such that one or more amino acid substitutions, additions or deletions are introduced into the encoded protein. Mutations can be introduced into the encoding sequences of SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 by standard techniques, such as site-directed mutagenesis and PCR-mediated mutagenesis.

Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucinei isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Thus, a predicted nonessential amino acid residue in a polypeptide of the invention or a polypeptide used in the process of the invention is preferably replaced with another amino acid residue from the same family. Alternatively, in another embodiment, mutations can be introduced randomly along all or part of a coding sequence of a nucleic acid molecule of the invention or used in the process of the invention, such as by saturation mutagenesis, and the resultant mutants can be screened for activity described herein to identify mutants that retain or even have increased above mentioned activity, e.g. conferring an increase in content of the fine chemical.

Following mutagenesis of one of the sequences of shown herein, the encoded protein can be expressed recombinantly and the activity of the protein can be determined using, for example, assays described herein (see Examples).

The highest homology of the nucleic acid molecule used in the process according to the invention was found for the following database entries by Gap search.

Homologues of the nucleic acid sequences used, with the sequence as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the sequences SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393. It is preferred that the nucleic acid molecule comprises as little as possible other nucleotides not shown in any one of SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393.

Also preferred is that the nucleic acid molecule used in the process of the invention encodes a polypeptide comprising the sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394.

In one embodiment, the nucleic acid molecule of the invention or used in the process encodes a polypeptide comprising the sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 and comprises less than 100 further nucleotides. In a further embodiment, said nucleic acid molecule comprises less than 30 further nucleotides. In one embodiment, the nucleic acid molecule used in the process is identical to a coding sequence of the sequences as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393.

Polypeptides (=proteins), which still have the essential enzymatic activity of the polypeptide of the present invention conferring an increase of the fine chemical i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 expressed under identical conditions.

Homologues of as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

In a further embodiment, the process according to the present invention comprises the following steps:
(a) selecting an organism or a part thereof expressing the polypeptide of this invention;
(b) mutagenizing the selected organism or the part thereof;
(c) comparing the activity or the expression level of said polypeptide in the mutagenized organism or the part thereof with the activity or the expression of said polypeptide in the selected organisms or the part thereof;
(d) selecting the mutagenized organisms or parts thereof, which comprise an increased activity or expression level of said polypeptide compared to the selected organism (a) or the part thereof;
(e) optionally, growing and cultivating the organisms or the parts thereof; and
(f) recovering, and optionally isolating, the free or bound the fine chemical produced by the selected mutated organisms or parts thereof.

The organisms or part thereof produce according to the herein mentioned process of the invention an increased level of free and/or protein-bound fine chemical compared to said control or selected organisms or parts thereof.

Advantageously the seclected organisms are mutagenized according to the invention. According to the invention mutagenesis is any change of the genetic information in the genom of an organism, that means any structural or compositional change in the nucleic acid preferably DNA of an organism that is not caused by normal segregation or genetic recombination processes. Such mutations may occur spontaneously, or may be induced by mutagens as described below. Such change can be induced either randomly or selectivly. In both cases the genetic information of the organism is modified. In general this lead to the situation that the activity of the gene product of the relevant genes inside the cells or inside the organism is increased.

In case of the specific or so called site directed mutagenesis a distinct gene is mutated and thereby its activity and/or the activity or the encoded gene product is repressed, reduced or increased, preferably increased. In the event of a random mutagenesis one or more genes are mutated by chance and their activities and/or the activities of their gene productes are repressed, reduced or increased, preferably increased.

For the purpose of a mutagenesis of a huge population of organisms, such population can be transformed with a DNA construct, which is useful for the activation of as much as possible genes of an organism, preferably all genes. For example the construct can contain a strong promoter or one or more enhancers, which are capable of transcriptionally activate genes in the vicinity of their integration side. With this method it is possible to statistically mutagenize, eg activate nearly all genes of an organism by the random integration of an activation construct. Afterwards the skilled worker can identify those mutagenized lines in which a gene of the invention has been activated, which in turns leads to the desired increase in the fine chemical production.

The genes of the invention can also be activated by mutagensis, either of regulatory or coding regions. In the event of a random mutagenesis a huge number of organisms are treated with a mutagenic agent. The amount of said agent and the intensity of the treatment will be chosen in such a manner that statistically nearly every gene is mutated once. The process for the random mutagensis as well as the respective agens is well known by the skilled person. Such methods are disclosed for example by A. M. van Harten [(1998), "Mutation breeding: theory and practical applications", Cambridge University Press, Cambridge, UK], E Friedberg, G Walker, W Siede [(1995), "DNA Repair and Mutagenesis", Blackwell Publishing], or K. Sankaranarayanan, J. M. Gentile, L. R. Ferguson [(2000), "Protocols in Mutagenesis", Elsevier Health Sciences]. As the skilled worker knows the spontaneous mutation rate in the cells of an organism is very low and that a large numer of chemical, physical or biological agents are available for the mutagenesis of organisms. These agents are named as mutagens or mutagenic agents. As mentioned before three different kinds of mutagens (chemical, physical or biological agents) are available.

There are different classes of chemical mutagens, which can be separated by their mode of action. For example base analogues such as 5-bromouracil, 2-amino purin. Other chemical mutagens are interacting with the DNA such as sulphuric acid, nitrous acid, hydroxylamine; or other alkylating agents such as monofunctional agents like ethyl methanesulfonate, dimethylsulfate, methyl methanesulfonate), bifunctional like dichloroethyl sulphide, Mitomycin, Nitrosoguanidine-dialkylnitrosamine, N-Nitrosoguanidin derivatives, N-alkyl-N-nitro-N-nitroso-guanidine-), ntercalating dyes like Acridine, ethidium bromide).

Physical mutagens are for example ionizing irradiation (X ray), UV irradiation. Different forms of irradiation are available and they are strong mutagens. Two main classes of irradiation can be distinguished: a) non-ionizing irradiation such as UV light or ionizing irradiation such as X ray. Biological mutagens are for example transposable elements for example IS elements such as IS100, transposons such as Tn5, Tn10, Tn916 or Tn1000 or phages like Mu$^{amplac}$, P1, T5, λplac etc. Methods for introducing this phage DNA into the appropriate microorganism are well known to the skilled worker (see Microbiology, Third Edition, Eds. Davis, B. D., Dulbecco, R., Eisen, H. N. and Ginsberg, H. S., Harper International Edition, 1980). The common procedure of a transposon mutagenesis is the insertion of a transposable element within a gene or nearby for example in the promotor or terminator region and thereby leading to a loss of the gene function. Procedures to localize the transposon within the genome of the organisms are well known by a person skilled in the art.

Preferably a chemical or biochemical procedure is used for the mutagenesis of the organisms. A preferred chemical method is the mutagensis with N-methyl-N-nitro-nitrosoguanidine.

Other biological methods are disclosed by Spee et al. (Nucleic Acids Research, Vol. 21, No. 3, 1993: 777-778). Spee et al. teaches a PCR method using dITP for the random mutagenesis. This method described by Spee et al. was further improved by Rellos et al. (Protein Expr. Purif., 5, 1994: 270-277). The use of an in vitro recombination technique for molecular mutagenesis is described by Stemmer (Proc. Natl. Acad. Sci. USA, Vol. 91, 1994: 10747-10751). Moore et al. (Nature Biotechnology Vol. 14, 1996: 458-467) describe the combination of the PCR and recombination methods for increasing the enzymatic activity of an esterase toward a para-nitrobenzyl ester. Another route to the mutagenesis of enzymes is described by Greener et al. in Methods in Molecular Biology (Vol. 57, 1996: 375-385). Greener et al. use the specific *Escherichia coli* strain XL1-Red to generate *Escherichia coli* mutants, which have increased antibiotic resistance.

In one embodiment, the protein according to the invention or the nucleic acid molecule characterized herein originates from a eukaryotic or prokaryotic organism such as a non-human animal, a plant, a microorganism such as a fungus, yeast, an alga, a diatom or a bacterium. Nucleic acid molecules, which advantageously can be used in the process of the invention originate from yeasts, for example the family Saccharomycetaceae, in particular the genus *Saccharomyces*, or yeast genera such as *Candida, Hansenula, Pichia, Yarrowia, Rhodotorula* or *Schizosaccharomyces* and the especially advantageous from the species *Saccharomyces cerevisiae*.

In one embodiment, nucleic acid molecules, which advantageously can be used in the process of the invention orginate from yeast, for example from Saccharomycetaceae, particularly from the genus *Saccharomyces* advantageously form the species *Saccharomyces cerevisiae*.

If, in the process according to the invention, plants are selected as the donor organism, this plant may, in principle, be in any phylogenetic relation of the recipient plant. Donor and recipient plant may belong to the same family, genus, species, variety or line, resulting in an increasing homology between the nucleic acids to be integrated and corresponding parts of the genome of the recipient plant. This also applies analogously to microorganisms as donor and recipient organism. It might also be advantageously to use nuclei acids molecules from very distinct species, since these might exhibit reduced sensitivity against endogenous regulatory mechanisms and such sequences might not be recognized by endogenous silencing mechanisms.

Accordingly, one embodiment of the application relates to the use of nucleic acid molecules in the process of the invention from plants, e.g. crop plants, e.g. from: *B. napus; O. sativa, Glycine max; B. vulgaris, L. japonicus, Z. elegans, Z. mays, C. arietinum, A. thaliana, H. vulgare, N. tabacum, G. hirsutum, P. patens, F. distichus*, sunflower linseed or maize or their homologues.

Accordingly, in one embodiment, the invention relates to a nucleic acid molecule, which comprises a nucleic acid molecule selected from the group consisting of:

a) nucleic acid molecule encoding of the polypeptide as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or a fragment thereof, which confers an increase in the amount of fine chemical in an organism or a part thereof;

b) nucleic acid molecule comprising of the nucleic acid molecule as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 or a fragment thereof, which confers an increase in the amount of fine chemical in an organism or a part thereof;

c) nucleic acid molecule whose sequence can be deduced from a polypeptide sequence encoded by a nucleic acid molecule of (a) or (b) as a result of the degeneracy of the genetic code and conferring an increase in the amount of fine chemical in an organism or a part thereof;

d) nucleic acid molecule which encodes a polypeptide which has at least 50% identity with the amino acid sequence of the polypeptide encoded by the nucleic acid molecule of (a) to (c) and conferring an increase in the amount of fine chemical in an organism or a part thereof;

e) nucleic acid molecule which hybridizes with a nucleic acid molecule of (a) to (c) under stringent hybridization conditions and conferring an increase in the amount of fine chemical in an organism or a part thereof;

f) nucleic acid molecule encoding a polypeptide, the polypeptide being derived by substituting, deleting and/or adding one or more amino acids of the amino acid sequence of the polypeptide encoded by the nucleic acid molecules (a) to (d), preferably to (a) to (c), and conferring an increase in the amount of the fine chemical in an organism or a part thereof;

g) nucleic acid molecule encoding a fragment or an epitope of a polypeptide which is encoded by one of the nucleic acid molecules of (a) to (e), preferably to (a) to (c) and conferring an increase in the amount of the fine chemical in an organism or a part thereof;

h) nucleic acid molecule which encompasses a nucleic acid molecule which is obtained by amplifying nucleic acid molecules from a cDNA library or a genomic library using the primers in SEQ ID NO: 53, SEQ ID NO: 54, SEQ ID NO: 395 or SEQ ID NO: 396 and conferring an increase in the amount of the fine chemical in an organism or a part thereof;

i) nucleic acid molecule encoding a polypeptide which is isolated, e.g. from a expression library, with the aid of monoclonal and/or polyclonal antibodies against a polypeptide encoded by one of the nucleic acid molecules of (a) to (g), preferably to (a) to (c) and conferring an increase in the amount of the fine chemical in an organism or a part thereof;

j) nucleic acid molecule encoding a polypeptide comprising the consensus sequence as depicted in SEQ ID NO: 47, SEQ ID NO: 48, SEQ ID NO: 49, SEQ ID NO: 50, SEQ ID NO: 51, SEQ ID NO: 52, SEQ ID NO: 397, SEQ ID NO: 398, SEQ ID NO: 399 and/or SEQ ID NO: 400 and conferring an increase in the amount of the fine chemical in an organism or a part thereof; and/or k) nucleic acid molecule which is obtainable by screening a suitable nucleic acid library under stringent hybridization conditions with a probe comprising one of the sequences of the nucleic acid molecule of (a) to (k) or with a fragment of at least 15 nt, preferably 20 nt, 30 nt, 50 nt, 100 nt, 200 nt or 500 nt of the nucleic acid molecule characterized in (a) to (h) or of the nucleic acid molecule as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 or a nucleic acid molecule encoding, preferably at least the mature form of, the polypeptide as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394, and conferring an increase in the amount of the fine chemical in an organism or a part thereof;

or which encompasses a sequence which is complementary thereto;

whereby, preferably, the nucleic acid molecule according to (a) to (k) distinguishes over the sequence as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 by one or more nucleotides. In one embodiment, the nucleic acid molecule of the invention does not consist of the sequence as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393. In an other embodiment, the nucleic acid molecule of the present invention is at least 30% identical and less than 100%, 99.999%, 99.99%, 99.9% or 99% identical to the sequence as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393. In a further embodiment the nucleic acid molecule does not encode the polypeptide sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394. Accordingly, in one embodiment, the nucleic acid molecule of the present invention encodes in one embodiment a polypeptide which differs at least in one or more amino acids from the polypeptide as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394. In another embodiment, the nucleic acid molecule as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 does not encode a protein of the sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394. Accordingly, in one embodiment, the protein encoded by a sequences of a nucleic acid accoriding to (a) to (k) does not consist of the sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394. In a further embodiment, the protein of the present invention is at least 30% identical to protein sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 and less than 100%, preferably less than 99.999%, 99.99% or 99.9%, more preferably less than 99%, 98%, 97%, 96% or 95% identical to the sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394.

The nucleic acid sequences used in the process are advantageously introduced in a nucleic acid construct, preferably an expression cassette, which makes the expression of the nucleic acid molecules in an organism, advantageously a plant or a microorganism possible.

Accordingly, the invention also relates to a nucleic acid construct, preferably to an expression construct, comprising the nucleic acid molecule of the present invention functionally linked to one or more regulatory elements or signals.

As described herein, the nucleic acid construct can also comprise further genes, which are introduced into the organisms or cells. It is possible and advantageous to introduce into, and express in, the host organisms regulatory genes such as genes for inductors, repressors or enzymes, which, owing to their enzymatic activity, engage in the regulation of one or more genes of a biosynthetic pathway. These genes can be of heterologous or homologous origin. Moreover, further biosynthesis genes may advantageously be present, or else these genes may be located on one or more further nucleic acid constructs. Genes, which are advantageously employed as biosynthesis genes are genes of the amino acid metabolism, of glycolysis, of the tricarboxylic acid metabolism or their combinations. As described herein, regulator sequences or factors can have a positive effect on preferably the gene expression of the genes introduced, thus increasing it. Thus, an enhancement of the regulator elements may advantageously take place at the transcriptional level by using strong transcription signals such as promoters and/or enhancers. In addition, however, an enhancement of translation is also possible, for example by increasing mRNA stability or by inserting a translation enhancer sequence.

In principle, the nucleic acid construct can comprise the herein described regulator sequences and further sequences relevant for the expression of the comprised genes. Thus, the nucleic acid construct of the invention can be used as expression cassette and thus can be used directly for introduction into the plant, or else they may be introduced into a vector. Accordingly in one embodiment the nucleic acid construct is an expression cassette comprising a microorganism promoter or a microorganism terminator or both. In another embodiment the expression cassette encompasses a plant promoter or a plant terminator or both.

Accordingly, in one embodiment, the process according to the invention comprises the following steps:
(a) introducing of a nucleic acid construct comprising the nucleic acid molecule of the invention or used in the process of the invention or encoding the polypeptide of the present invention or used in the process of the invention; or
(b) introducing of a nucleic acid molecule, including regulatory sequences or factors, which expression increases the expression of the nucleic acid molecule of the invention or used in the process of the invention or encoding the polypeptide of the present invention or used in the process of the invention in a cell, or an organism or a part thereof, preferably in a plant, plant cell or a microorganism, and
(c) expressing of the gene product encoded by the nucleic acid construct or the nucleic acid molecule mentioned under (a) or (b) in the cell or the organism.

After the introduction and expression of the nucleic acid construct the transgenic organism or cell is advantageously cultured and subsequently harvested. The transgenic organism or cell may be a prokaryotic or eukaryotic organism such as a microorganism, a non-human animal and plant for example a plant or animal cell, a plant or animal tissue, preferably a crop plant, or a part thereof.

To introduce a nucleic acid molecule into a nucleic acid construct, e.g. as part of an expression cassette, the codogenic gene segment is advantageously subjected to an amplification and ligation reaction in the manner known by a skilled person. It is preferred to follow a procedure similar to the protocol for the Pfu DNA polymerase or a Pfu/Taq DNA polymerase mixture. The primers are selected according to the sequence to be amplified. The primers should expediently be chosen in such a way that the amplificate comprise the codogenic sequence from the start to the stop codon. After the amplification, the amplificate is expediently analyzed. For example, the analysis may consider quality and quantity and be carried out following separation by gel electrophoresis. Thereafter, the amplificate can be purified following a standard protocol (for example Qiagen). An aliquot of the purified amplificate is then available for the subsequent cloning step. The skilled worker generally knows suitable cloning vectors.

They include, in particular, vectors which are capable of replication in easy to handle cloning systems like as bacterial yeast or insect cell based (e.g. baculovirus expression) systems, that is to say especially vectors which ensure efficient cloning in *E. coli*, and which make possible the stable transformation of plants. Vectors, which must be mentioned, in particular are various binary and cointegrated vector systems, which are suitable for the T-DNA-mediated transformation. Such vector systems are generally characterized in that they contain at least the vir genes, which are required for the *Agrobacterium*-mediated transformation, and the T-DNA border sequences.

In general, vector systems preferably also comprise further cis-regulatory regions such as promoters and terminators and/or selection markers by means of which suitably transformed organisms can be identified. While vir genes and T-DNA sequences are located on the same vector in the case of cointegrated vector systems, binary systems are based on at least two vectors, one of which bears vir genes, but no T-DNA, while a second one bears T-DNA, but no vir gene. Owing to this fact, the last-mentioned vectors are relatively small, easy to manipulate and capable of replication in *E. coli* and in *Agrobacterium*. These binary vectors include vectors from the series pBIB-HYG, pPZP, pBecks, pGreen. Those, which are preferably used in accordance with the invention, are Bin19, pBI101, pBinAR, pGPTV and pCAMBIA. An overview of binary vectors and their use is given by Hellens et al, Trends in Plant Science (2000) 5, 446-451.

For a vector preparation, vectors may first be linearized using restriction endonuclease(s) and then be modified enzymatically in a suitable manner. Thereafter, the vector is purified, and an aliquot is employed in the cloning step. In the cloning step, the enzyme-cleaved and, if required, purified amplificate is cloned together with similarly prepared vector fragments, using ligase. In this context, a specific nucleic acid construct, or vector or plasmid construct, may have one or else more codogenic gene segments. The codogenic gene segments in these constructs are preferably linked operably to regulatory sequences. The regulatory sequences include, in particular, plant sequences like the above-described promoters and terminators. The constructs can advantageously be propagated stably in microorganisms, in particular *Escherichia coli* and/or *Agrobacterium tumefaciens*, under selective conditions and enable the transfer of heterologous DNA into plants or other microorganisms. In accordance with a particular embodiment, the constructs are based on binary vectors (overview of a binary vector: Hellens et al., 2000). As a rule, they contain prokaryotic regulatory sequences, such as replication origin and selection markers, for the multiplication in microorganisms such as *Escherichia coli* and *Agrobacterium tumefaciens*. Vectors can further contain agrobacterial T-DNA sequences for the transfer of DNA into plant genomes or other eukaryotic regulatory sequences for transfer into other eukaryotic cells, e.g. *Saccharomyces* sp. or other prokaryotic regulatory sequences for the transfer into other prokaryotic cells, e.g. *Corynebacterium* sp. or *Bacillus* sp. For the transformation of plants, the right border sequence, which comprises approximately 25 base pairs, of the total agrobacterial T-DNA sequence is advantageously included. Usually, the plant transformation vector constructs according to the invention contain T-DNA sequences both from the right and from the left border region, which contain expedient recognition sites for site-specific acting enzymes, which, in turn, are encoded by some of the vir genes.

Suitable host organisms are known to the skilled worker. Advantageous organisms are described further above in the present application. They include in particular eukaryotes or eubacteria, e.g. prokaryotes or archae bacteria. Advantageously host organisms are microorganisms selected from the group consisting of Actinomycetaceae, Bacillaceae, Brevibacteriaceae, Corynebacteriaceae, Enterobacteriacae, Gordoniaceae, Micrococcaceae, Mycobacteriaceae, Nocardiaceae, Pseudomonaceae, Rhizobiaceae, Streptomycetaceae, Chaetomiaceae, Choanephoraceae, Cryptococcaceae, Cunninghamellaceae, Demetiaceae, Moniliaceae, Mortierellaceae, Mucoraceae, Pythiaceae, Saccharomycetaceae, Saprolegniaceae, Schizosaccharomycetaceae, Sodariaceae, Sporobolomycetaceae, Tuberculariaceae, Adelotheciaceae, Dinophyceae, Ditrichaceae and Prasinophyceae. Preferably are unicellular, microorganisms, e.g. fungi, bacteria or protoza, such as fungi like the genus *Claviceps* or *Aspergillus* or gram-positive bacteria such as the genera *Bacillus*, *Corynebacterium*, *Micrococcus*, *Brevibacterium*, *Rhodococcus*, *Nocardia*, *Caseobacter* or *Arthrobacter* or gram-negative bacteria such as the genera *Escherichia*, *Flavobacterium* or *Salmonella*, or yeasts such as the genera *Rhodotorula*, *Hansenula*, *Pichia*, *Yerrowia*, *Saccharomyces*, *Schizosaccharomyces* or *Candida*.

Host organisms which are especially advantageously selected in the process according to the invention are microorganisms selected from the group of the genera and species consisting of *Hansenula anomala*, *Saccharomyces cerevisiae*, *Candida utilis*, *Claviceps purpurea*, *Bacillus circulans*, *Bacillus subtilis*, *Bacillus* sp., *Brevibacterium albidum*, *Brevibacterium album*, *Brevibacterium cerinum*, *Brevibacterium flavum*, *Brevibacterium glutamigenes*, *Brevibacterium iodinum*, *Brevibacterium ketoglutamicum*, *Brevibacterium lactofermentum*, *Brevibacterium linens*, *Brevibacterium roseum*, *Brevibacterium saccharolyticum*, *Brevibacterium* sp., *Corynebacterium acetoacidophilum*, *Corynebacterium acetoglutamicum*, *Corynebacterium ammoniagenes*, *Corynebacterium glutamicum* (=*Micrococcus glutamicum*), *Corynebacterium melassecola*, *Corynebacterium* sp. or *Escherichia coli*, specifically *Saccharomyces cerevisiae* or *Escherichia coli* K12 and its described strains.

Advantageously preferred in accordance with the invention are host organisms of the genus *Agrobacterium tumefaciens* or plants. Preferred plants are selected from among the families Aceraceae, Anacardiaceae, Apiaceae, Asteraceae, Apiaceae, Betulaceae, Boraginaceae, Brassicaceae, Bromeliaceae, Cactaceae, Caricaceae, Caryophyllaceae, Cannabaceae, Convolvulaceae, Chenopodiaceae, Elaeagnaceae, Geraniaceae, Gramineae, Juglandaceae, Lauraceae, Leguminosae, Linaceae, Cucurbitaceae, Cyperaceae, Euphorbiaceae, Fabaceae, Malvaceae, Nymphaeaceae, Papaveraceae, Rosaceae, Salicaceae, Solanaceae, Arecaceae, Iridaceae, Liliaceae, Orchidaceae, Gentianaceae, Labiaceae, Magnoliaceae, Ranunculaceae, Carifolaceae, Rubiaceae, Scrophulariaceae, Ericaceae, Polygonaceae, Violaceae, Juncaceae, Poaceae, perennial grass, fodder crops, vegetables and ornamentals.

Especially preferred are plants selected from the groups of the families Apiaceae, Asteraceae, Brassicaceae, Cucurbitaceae, Fabaceae, Papaveraceae, Rosaceae, Solanaceae, Liliaceae or Poaceae. Especially advantageous are, in particular, crop plants. Accordingly, an advantageous plant preferably belongs to the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassava, potato, sugarbeet, fodder beet, egg plant, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, alfalfa, dwarf bean, lupin, clover and lucerne.

In order to introduce, into a plant, the nucleic acid molecule of the invention or used in the process according to the invention, it has proved advantageous first to transfer them into an intermediate host, for example a bacterium or a eukaryotic unicellular cell. The transformation into *E. coli*, which can be carried out in a manner known per se, for example by means of heat shock or electroporation, has proved itself expedient in this context. Thus, the transformed *E. coli* colonies can be analysed for their cloning efficiency. This can be carried out with the aid of a PCR. Here, not only the identity, but also the integrity, of the plasmid construct can be verified with the aid of a defined colony number by subjecting an aliquot of the colonies to said PCR. As a rule, universal primers which are derived from vector sequences are used for this purpose, it being possible, for example, for a forward primer to be arranged upstream of the start ATG and a reverse primer to be arranged downstream of the stop codon of the codogenic gene segment. The amplificates are separated by electrophoresis and assessed with regard to quantity and quality.

The nucleic acid constructs, which are optionally verified, are subsequently used for the transformation of the plants or other hosts, e.g. other eukaryotic cells or other prokaryotic cells. To this end, it may first be necessary to obtain the constructs from the intermediate host. For example, the constructs may be obtained as plasmids from bacterial hosts by a method similar to conventional plasmid isolation.

The nucleic acid molecule of the invention or used in the process according to the invention can also be introduced into modified viral vectors like baculovirus vectors for expression in insect cells or plant viral vectors like tobacco mosaic virus or potato virus X-based vectors. Approaches leading to the expression of proteins from the modified viral genome including the the nucleic acid molecule of the invention or used in the process according to the invention involve for example the inoculation of tobacco plants with infectious RNA transcribed in vitro from a cDNA copy of the recombinant viral genome. Another approach utilizes the transfection of whole plants from wounds inoculated with *Agrobacterium tumefaciens* containing cDNA copies of recombinant plus-sense RNA viruses. Different vectors and virus are known to the skilled worker for expression in different target eg. production plants.

A large number of methods for the transformation of plants are known. Since, in accordance with the invention, a stable integration of heterologous DNA into the genome of plants is advantageous, the T-DNA-mediated transformation has proved expedient in particular. For this purpose, it is first necessary to transform suitable vehicles, in particular agrobacteria, with a codogenic gene segment or the corresponding plasmid construct comprising the nucleic acid molecule of the invention. This can be carried out in a manner known per se. For example, said nucleic acid construct of the invention, or said expression construct or said plasmid construct, which has been generated in accordance with what has been detailed above, can be transformed into competent agrobacteria by means of electroporation or heat shock. In principle, one must differentiate between the formation of cointegrated vectors on the one hand and the transformation with binary vectors on the other hand. In the case of the first alternative, the constructs, which comprise the codogenic gene segment or the nucleic acid molecule of the invention have no T-DNA sequences, but the formation of the cointegrated vectors or constructs takes place in the agrobacteria by homologous recombination of the construct with T-DNA. The T-DNA is present in the agrobacteria in the form of Ti or Ri plasmids in which exogenous DNA has expediently replaced the oncogenes. If binary vectors are used, they can be transferred to agrobacteria either by bacterial conjugation or by direct transfer. These agrobacteria expediently already comprise the vector bearing the vir genes (currently referred to as helper Ti(Ri) plasmid).

One or more markers may expediently also be used together with the nucleic acid construct, or the vector of the invention and, if plants or plant cells shall be transformed together with the T-DNA, with the aid of which the isolation or selection of transformed organisms, such as agrobacteria or transformed plant cells, is possible. These marker genes enable the identification of a successful transfer of the nucleic acid molecules according to the invention via a series of different principles, for example via visual identification with the aid of fluorescence, luminescence or in the wavelength range of light which is discernible for the human eye, by a resistance to herbicides or antibiotics, via what are known as nutritive markers (auxotrophism markers) or antinutritive markers, via enzyme assays or via phytohormones. Examples of such markers which may be mentioned are GFP (=green fluorescent protein); the luciferin/luceferase system, the β-galactosidase with its colored substrates, for example X-Gal, the herbicide resistances to, for example, imidazolinone, glyphosate, phosphinothricin or sulfonylurea, the antibiotic resistances to, for example, bleomycin, hygromycin, streptomycin, kanamycin, tetracyclin, chloramphenicol, ampicillin, gentamycin, geneticin (G418), spectinomycin or blasticidin, to mention only a few, nutritive markers such as the utilization of mannose or xylose, or antinutritive markers such as the resistance to 2-deoxyglucose. This list is a small number of possible markers. The skilled worker is very familiar with such markers. Different markers are preferred, depending on the organism and the selection method.

As a rule, it is desired that the plant nucleic acid constructs are flanked by T-DNA at one or both sides of the codogenic gene segment. This is particularly useful when bacteria of the species *Agrobacterium tumefaciens* or *Agrobacterium rhizogenes* are used for the transformation. A method, which is preferred in accordance with the invention, is the transformation with the aid of *Agrobacterium tumefaciens*. However, biolistic methods may also be used advantageously for introducing the sequences in the process according to the invention, and the introduction by means of PEG is also possible. The transformed agrobacteria can be grown in the manner known per se and are thus available for the expedient transformation of the plants. The plants or plant parts to be transformed are grown or provided in the customary manner. The transformed agrobacteria are subsequently allowed to act on the plants or plant parts until a sufficient transformation rate is reached. Allowing the agrobacteria to act on the plants or plant parts can take different forms. For example, a culture of morphogenic plant cells or tissue may be used. After the T-DNA transfer, antibiotics as a rule eliminate the bacteria, and the regeneration of plant tissue is induced. This is done in particular using suitable plant hormones in order to initially induce callus formation and then to promote shoot development.

The transfer of foreign genes into the genome of a plant is called transformation. In doing this the methods described for the transformation and regeneration of plants from plant tissues or plant cells are utilized for transient or stable transformation. An advantageous transformation method is the transformation in planta. To this end, it is possible, for example, to allow the agrobacteria to act on plant seeds or to inoculate the plant meristem with agrobacteria. It has proved particularly expedient in accordance with the invention to allow a suspension of transformed agrobacteria to act on the intact plant or at least the flower primordia. The plant is subsequently grown on until the seeds of the treated plant are obtained (Clough and Bent, Plant J. (1998) 16, 735-743). To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Further advantageous transformation methods, in particular for plants, are known to the skilled worker and are described hereinbelow.

Further advantageous and suitable methods are protoplast transformation by poly (ethylene glycol)-induced DNA uptake, the "biolistic" method using the gene cannon—referred to as the particle bombardment method, electroporation, the incubation of dry embryos in DNA solution, microinjection and gene transfer mediated by *Agrobacterium*. Said methods are described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). Agrobacteria transformed by such a vector can then be used in known manner for the transformation of plants, in particular of crop plants such as by way of example tobacco plants, for example by bathing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

The abovementioned nucleic acid molecules can be cloned into the nucleic acid constructs or vectors according to the invention in combination together with further genes, or else different genes are introduced by transforming several nucleic acid constructs or vectors (including plasmids) into a host cell, advantageously into a plant cell or a microorganisms.

In addition to the sequence mentioned in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 or its derivatives, it is advantageous additionally to express and/or mutate further genes in the organisms. Especially advantageously, additionally at least one further gene of the fine chemical biosynthetic pathway e.g. the amino acid biosynthetic pathway such as for L-tryptophane, L-isoleucine, L-leucine, L-lysine, L-threonine and/or L-methionine to mention only a couple of them is expressed in the organisms such as plants or microorganisms. It is also possible that the regulation of the natural genes has been modified advantageously so that the gene and/or its gene product is no longer subject to the regulatory mechanisms which exist in the organisms. This leads to an increased synthesis of the fine chemicals e.g. the amino acids desired since, for example, feedback regulations no longer exist to the same extent or not at all. In addition it might be advantageous to combine the sequences shown in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 with genes which generally support or enhances to growth or yield of the target organismen, for example genes which lead to faster growth rate of microorganisms or genes which produces stress-, pathogen, or herbicide resistant plants.

In a further embodiment of the process of the invention, therefore, organisms are grown, in which there is simultaneous overexpression of at least one nucleic acid or one of the genes which code for proteins involved in the fine chemical metabolism e.g. the amino acid metabolism, in particular in amino acid synthesis.

A further advantageous nucleic acid sequence which can be expressed in combination with the sequences used in the process and/or the abovementioned biosynthesis genes is the sequence of the ATP/ADP translocator as described in WO 01/20009. This ATP/ADP translocator leads to an increased synthesis of the essential amino acids lysine and/or methionine. Furthermore, an advantageous nucleic acid sequence coexpressed can be threonine adlolase and/or lysine decarboxylase as described in the state of the art.

In a further advantageous embodiment of the process of the invention, the organisms used in the process are those in which simultaneously at least one of the aforementioned genes or one of the aforementioned nucleic acids is mutated so that the activity of the corresponding proteins is influenced by metabolites to a smaller extent compared with the unmutated proteins, or not at all, and that in particular the production according to the invention of the fine chemical for example of the amino acids is not impaired, or so that their specific enzymatic activity is increased. Less influence means in this connection that the regulation of the enzymic activity is less by at least 10%, advantageously at least 20, 30 or 40%, particularly advantageously by at least 50, 60 or 70%, compared with the starting organism, and thus the activity of the enzyme is increased by these figures mentioned compared with the starting organism. An increase in the enzymatic activity means an enzymatic activity which is increased by at least 10%, advantageously at least 20, 30 or 40%, particularly advantageously by at least 50, 60 or 70%, compared with the starting organism. This leads to an increased productivity of the fine chemical.

In a further advantageous embodiment of the process of the invention, the organisms used in the process are those in which simultaneously the fine chemical degrading protein is attenuated, in particular by reducing the rate of expression of the corresponding gene.

In another embodiment of the process of the invention, the organisms used in the process are those in which simultaneously at least one of the aforementioned nucleic acids or of the aforementioned genes is mutated in such a way that the enzymatic activity of the corresponding protein is partially reduced or completely blocked. A reduction in the enzymatic activity means an enzymatic activity, which is reduced by at least 10%, advantageously at least 20, 30 or 40%, particularly advantageously by at least 50, 60 or 70%, preferably more, compared with the starting organism.

If it is intended to transform the host cell, in particular the plant cell, with several constructs or vectors, the marker of a preceding transformation must be removed or a further marker employed in a following transformation. The markers can be removed from the host cell, in particular the plant cell, as described hereinbelow via methods with which the skilled worker is familiar. In particular plants without a marker, in particular without resistance to antibiotics, are an especially preferred embodiment of the present invention.

In the process according to the invention, the nucleic acid sequences used in the process according to the invention are advantageously linked operably to one or more regulatory signals in order to increase gene expression. These regulatory sequences are intended to enable the specific expression of the genes and the expression of protein. Depending on the host organism for example plant or microorganism, this may mean, for example, that the gene is expressed and/or overexpressed after induction only, or that it is expressed and/or overexpressed constitutively. These regulatory sequences are, for example, sequences to which the inductors or repressors bind and which thus regulate the expression of the nucleic acid. In addition to these novel regulatory sequences, or instead of these sequences, the natural regulation of these sequences may still be present before the actual structural genes and, if appropriate, may have been genetically modified so that the natural regulation has been switched off and gene expression has been increased. However, the nucleic acid construct of the invention suitable as expression cassette (=expression construct=gene construct) can also be simpler in construction, that is to say no additional regulatory signals have been inserted before the nucleic acid sequence or its derivatives, and the natural promoter together with its regulation has not been removed. Instead, the natural regulatory sequence has been mutated in such a way that regulation no longer takes place and/or gene expression is increased. These modified promoters can also be introduced on their own before the natural gene in the form of part sequences (=promoter with parts of the nucleic acid sequences according to the invention) in order to increase the activity. Moreover, the gene construct can advantageously also comprise one or more of what are known as enhancer sequences in operable linkage with the promoter, and these enable an increased expression of the nucleic acid sequence. Also, it is possible to insert additional advantageous sequences at the 3' end of the DNA sequences, such as, for example, further regulatory elements or terminators.

The nucleic acid molecules, which encode proteins according to the invention and nucleic acid molecules, which encode other polypeptides may be present in one nucleic acid construct or vector or in several ones. Advantageously, only one copy of the nucleic acid molecule of the invention or its encoding genes is present in the nucleic acid construct or vector. Several vectors or nucleic acid construct or vector can be expressed together in the host organism. The nucleic acid molecule or the nucleic acid construct or vector according to the invention can be inserted in a vector and be present in the cell in a free form. If a stable transformation is preferred, a vector is used, which is stably duplicated over several generations or which is else be inserted into the genome. In the case of plants, integration into the plastid genome or, in particular, into the nuclear genome may have taken place. For the insertion of more than one gene in the host genome the genes to be expressed are present together in one gene construct, for example in above-described vectors bearing a plurality of genes.

As a rule, regulatory sequences for the expression rate of a gene are located upstream (5'), within, and/or downstream (3') relative to to the coding sequence of the nucleic acid molecule of the invention or another codogenic gene segment. They control in particular transcription and/or translation and/or the transcript stability. The expression level is dependent on the conjunction of further cellular regulatory systems, such as the protein biosynthesis and degradation systems of the cell.

Regulatory sequences include transcription and translation regulating sequences or signals, e.g. sequences located upstream (5'), which concern in particular the regulation of transcription or translation initiation, such as promoters or start codons, and sequences located downstream (3'), which concern in particular the regulation of transcription or translation termination and transcript stability, such as polyadenylation signals or stop codons. Regulatory sequences can also be present in transcribed coding regions as well in transcribed non-coding regions, e.g. in introns, as for example splicing sites. Promoters for the regulation of expression of the nucleic acid molecule according to the invention in a cell and which can be employed are, in principle, all those which are capable of stimulating the transcription of genes in the organisms in question, such as microorganisms or plants. Suitable promoters, which are functional in these organisms, are generally known. They may take the form of constitutive or inducible promoters. Suitable promoters can enable the development- and/or tissue-specific expression in multi-celled eukaryotes; thus, leaf-, root-, flower-, seed-, stomata-, tuber- or fruit-specific promoters may advantageously be used in plants.

The regulatory sequences or factors can, as described above, have a positive effect on, the expression of the genes introduced, thus increasing their expression. Thus, an enhancement of the expression can advantageously take place at the transcriptional level by using strong transcription signals such as strong promoters and/or strong enhancers. In addition, enhancement of expression on the translational level is also possible, for example by introducing translation enhancer sequences, e.g., the $\Omega$ enhancer e.g. improving the ribosomal binding to the transcript, or by increasing the stability of the mRNA, e.g. by replacing the 3'UTR coding region by a region encoding a 3'UTR known as conferring an high stability of the transcript or by stabilization of the transcript through the elimination of transcript instability, so that the mRNA molecule is translated more often than the wild type. For example in plants AU-rich elements (AREs) and DST (downstream) elements destabilized transcripts. Mutagenesis studies have demonstrated that residues within two of the conserved domains, the ATAGAT and the GTA regions, are necessary for instability function. Therefore removal or mutation of such elements would obviously lead to more stable transcripts, higher transcript rates and higher protein acitivity. Translation enhancers are also the "overdrive sequence", which comprises the tobacco mosaic virus 5'-untranslated leader sequence and which increases the protein/RNA ratio (Gallie et al., 1987, Nucl. Acids Research 15:8693-8711)

Enhancers are generally defined as cis active elements, which can stimulate gene transcription independent of position and orientation. Different enhancers have been identified in plants, which can either stimulate transcription constitutively or tissue or stimuli specific. Well known examples for constitutive enhancers are the enhancer from the 35S promoter (Odell et al., 1985, Nature 313:810-812) or the ocs enhancer (Fromm et al., 1989, Plant Cell 1: 977:984) Another examples are the G-Box motif tetramer which confers high-level constitutive expression in dicot and monocot plants (Ishige et al., 1999, Plant Journal, 18, 443-448) or the petE, a A/T-rich sequence which act as quantitative enhancers of gene expression in transgenic tobacco and potato plants (Sandhu et al., 1998; Plant Mol Biol. 37(5):885-96). Beside that, a large variety of cis-active elements have been described which contribute to specific expression pattern, like organ specific expression or induced expression in response to biotic or abiotic stress. Examples are elements, which provide pathogen or wound-induced expression (Rushton, 2002, Plant Cell, 14, 749-762) or guard cell-specific expression (Plesch, 2001, Plant Journal 28, 455-464).

Advantageous regulatory sequences for the expression of the nucleic acid molecule according to the invention in microorganisms are present for example in promoters such as the cos, tac, rha, trp, tet, trp-tet, lpp, lac, lpp-lac, lacI$^{q-}$, T7, T5, T3, gal, trc, ara, SP6, λ-P$_R$ or λ-P$_L$ promoter, which are advantageously used in Gram-negative bacteria. Further advantageous regulatory sequences are present for example in the Gram-positive promoters amy, dnak, xylS and SPO2, in the yeast or fungal promoters ADC1, MFα, AC, P-60, UASH, MCB, PHO, CYC1, GAPDH, TEF, rp28, ADH. Promoters, which are particularly advantageous, are constitutive, tissue or compartment specific and inducible promoters. In general, "promoter" is understood as meaning, in the present context, a regulatory sequence in a nucleic acid molecule, which mediates the expression of a coding sequence segment of a nucleic acid molecule. In general, the promoter is located upstream to the coding sequence segment. Some elements, for example expression-enhancing elements such as enhancer may, however, also be located downstream or even in the transcribed region.

In principle, it is possible to use natural promoters together with their regulatory sequences, such as those mentioned above, for the novel process. It is also possible advantageously to use synthetic promoters, either additionally or alone, in particular when they mediate seed-specific expression such as described in, for example, WO 99/16890.

The expression of the nucleic acid molecules used in the process may be desired alone or in combination with other genes or nucleic acids. Multiple nucleic acid molecules conferring the expression of advantageous genes can be introduced via the simultaneous transformation of several individual suitable nucleic acid constructs, i.e. expression constructs, or, preferably, by combining several expression cassettes on one construct. It is also possible to transform several vectors with in each case several expression cassettes stepwise into the recipient organisms.

As described above, the transcription of the genes introduced should advantageously be terminated by suitable terminators at the 3' end of the biosynthesis genes introduced (behind the stop codon). A terminator, which may be used for this purpose is, for example, the OCS1 terminator, the nos3 terminator or the 35S terminator. As is the case with the promoters, different terminator sequences should be used for each gene. Terminators, which are useful in microorganism, are for example the fimA terminator, txn terminator or trp terminator. Such terminators can be rho-dependent or rho-independent.

Different plant promoters such as, for example, the USP, the LegB4-, the DC3 promoter or the ubiquitin promoter from parsley or other herein mentioned promoter and different terminators may advantageously be used in the nucleic acid construct.

In order to ensure the stable integration, into the transgenic plant, of nucleic acid molecules used in the process according to the invention in combination with further biosynthesis genes over a plurality of generations, each of the coding regions used in the process should be expressed under the control of its own, preferably unique, promoter since repeating sequence motifs may lead to recombination events or to silencing or, in plants, to instability of the T-DNA.

The nucleic acid construct is advantageously constructed in such a way that a promoter is followed by a suitable cleavage site for insertion of the nucleic acid to be expressed, advantageously in a polylinker, followed, if appropriate, by a terminator located behind the polylinker. If appropriate, this order is repeated several times so that several genes are combined in one construct and thus can be introduced into the transgenic plant in order to be expressed. The sequence is advantageously repeated up to three times. For the expression, the nucleic acid sequences are inserted via the suitable cleavage site, for example in the polylinker behind the promoter. It is advantageous for each nucleic acid sequence to have its own promoter and, if appropriate, its own terminator, as mentioned above. However, it is also possible to insert several nucleic acid sequences behind a promoter and, if appropriate, before a terminator if a polycistronic transcription is possible in the host or target cells. In this context, the insertion site, or the sequence of the nucleic acid molecules inserted, in the nucleic acid construct is not decisive, that is to say a nucleic acid molecule can be inserted in the first or last position in the cassette without this having a substantial effect on the expression. However, it is also possible to use only one promoter type in the construct. However, this may lead to undesired recombination events or silencing effects, as said.

Accordingly, in a preferred embodiment, the nucleic acid construct according to the invention confers expression of the nucleic acid molecule of the invention, and, optionally further genes, in a plant and comprises one or more plant regulatory elements. Said nucleic acid construct according to the invention advantageously encompasses a plant promoter or a plant terminator or a plant promoter and a plant terminator.

A "plant" promoter comprises regulatory elements, which mediate the expression of a coding sequence segment in plant cells. Accordingly, a plant promoter need not be of plant origin, but may originate from viruses or microorganisms, in particular for example from viruses which attack plant cells.

The plant promoter can also originates from a plant cell, e.g. from the plant, which is transformed with the nucleic acid construct or vector as described herein. This also applies to other "plant" regulatory signals, for example in "plant" terminators.

A nucleic acid construct suitable for plant expression preferably comprises regulatory elements which are capable of controlling the expression of genes in plant cells and which are operably linked so that each sequence can fulfill its function. Accordingly, the nucleic acid construct can also comprise transcription terminators. Examples for transcriptional termination are polyadenylation signals. Preferred polyadenylation signals are those which originate from *Agrobacterium tumefaciens* T-DNA, such as the gene 3 of the Ti plasmid pTiACH5, which is known as octopine synthase (Gielen et al., EMBO J. 3 (1984) 835 et seq.) or functional equivalents thereof, but all the other terminators which are functionally active in plants are also suitable.

The nucleic acid construct suitable for plant expression preferably also comprises other operably linked regulatory elements such as translation enhancers, for example the overdrive sequence, which comprises the tobacco mosaic virus 5'-untranslated leader sequence, which increases the protein/RNA ratio (Gallie et al., 1987, Nucl. Acids Research 15:8693-8711).

Other preferred sequences for use in operable linkage in gene expression constructs are targeting sequences, which are required for targeting the gene product into specific cell compartments (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention to achieve an expression in one of said compartments or extracellular.

For expression in plants, the nucleic acid molecule must, as described above, be linked operably to or comprise a suitable promoter which expresses the gene at the right point in time and in a cell- or tissue-specific manner. Usable promoters are constitutive promoters (Benfey et al., EMBO J. 8 (1989) 2195-2202), such as those which originate from plant viruses, such as 35S CAMV (Franck et al., Cell 21 (1980) 285-294), 19S CaMV (see also U.S. Pat. No. 5,352,605 and WO 84/02913), 34S FMV (Sanger et al., Plant. Mol. Biol., 14, 1990: 433-443), the parsley ubiquitin promoter, or plant promoters such as the Rubisco small subunit promoter described in U.S. Pat. No. 4,962,028 or the plant promoters PRP1 [Ward et al., Plant. Mol. Biol. 22 (1993)], SSU, PGEL1, OCS [Leisner (1988) Proc Natl Acad Sci USA 85(5): 2553-2557], lib4, usp, mas [Comai (1990) Plant Mol Biol 15 (3):373-381], STLS1, ScBV (Schenk (1999) Plant Mol Biol 39(6):1221-1230), B33, SAD1 or SAD2 (flax promoters, Jain et al., Crop Science, 39 (6), 1999: 1696-1701) or nos [Shaw et al. (1984) Nucleic Acids Res. 12(20):7831-7846]. Stable, constitutive expression of the proteins according to the invention a plant can be advantageous. However, inducible expression of the polypeptide of the invention is advantageous, if a late expression before the harvest is of advantage, as metabolic manipulation may lead to a plant growth retardation.

The expression of plant genes can also be facilitated as described above via a chemical inducible promoter (for a review, see Gatz 1997, Annu. Rev. Plant Physiol. Plant Mol. Biol., 48:89-108). Chemically inducible promoters are particularly suitable when it is desired to express the gene in a time-specific manner. Examples of such promoters are a salicylic acid inducible promoter (WO 95/19443), and abscisic acid-inducible promoter (EP 335 528), a tetracyclin-inducible promoter (Gatz et al. (1992) Plant J. 2, 397-404), a cyclohexanol- or ethanol-inducible promoter (WO 93/21334) or others as described herein.

Other suitable promoters are those which react to biotic or abiotic stress conditions, for example the pathogen-induced PRP1 gene promoter (Ward et al., Plant. Mol. Biol. 22 (1993) 361-366), the tomato heat-inducible hsp80 promoter (U.S. Pat. No. 5,187,267), the potato chill-inducible alpha-amylase promoter (WO 96/12814) or the wound-inducible pinII promoter (EP-A-0 375 091) or others as described herein.

Preferred promoters are in particular those which bring about gene expression in tissues and organs in which the biosynthesis of fine chemical takes place, in seed cells, such as endosperm cells and cells of the developing embryo. Suitable promoters are the oilseed rape napin gene promoter (U.S. Pat. No. 5,608,152), the Vicia faba USP promoter (Baeumlein et al., Mol Gen Genet, 1991, 225 (3):459-67), the *Arabidopsis* oleosin promoter (WO 98/45461), the *Phaseolus vulgaris* phaseolin promoter (U.S. Pat. No. 5,504,200), the *Brassica* Bce4 promoter (WO 91/13980), the bean arc5 promoter, the carrot DcG3 promoter, or the Legumin B4 promoter (LeB4; Baeumlein et al., 1992, Plant Journal, 2 (2):233-9), and promoters which bring about the seed-specific expression in monocotyledonous plants such as maize, barley, wheat, rye, rice and the like. Advantageous seed-specific promoters are the sucrose binding protein promoter (WO 00/26388), the phaseolin promoter and the napin promoter. Suitable promoters which must be considered are the barley lpt2 or lpt1 gene promoter (WO 95/15389 and WO 95/23230), and the promoters described in WO 99/16890 (promoters from the barley hordein gene, the rice glutelin gene, the rice oryzin gene, the rice prolamin gene, the wheat gliadin gene, the wheat glutelin gene, the maize zein gene, the oat glutelin gene, the sorghum kasirin gene and the rye secalin gene). Further suitable promoters are Amy32b, Amy 6-6 and Aleurain [U.S. Pat. No. 5,677,474], Bce4 (oilseed rape) [U.S. Pat. No. 5,530,149], glycinin (soya) [EP 571 741], phosphoenolpyruvate carboxylase (soya) [JP 06/62870], ADR12-2 (soya) [WO 98/08962], isocitrate lyase (oilseed rape) [U.S. Pat. No. 5,689,040] or α-amylase (barley) [EP 781 849]. Other promoters which are available for the expression of genes in plants are leaf-specific promoters such as those described in DE-A 19644478 or light-regulated promoters such as, for example, the pea petE promoter.

Further suitable plant promoters are the cytosolic FBPase promoter or the potato ST-LSI promoter (Stockhaus et al., EMBO J. 8, 1989, 2445), the Glycine max phosphoribosylpyrophosphate amidotransferase promoter (GenBank Accession No. U87999) or the node-specific promoter described in EP-A-0 249 676.

Other promoters, which are particularly suitable, are those, which bring about plastid-specific expression. Suitable promoters such as the viral RNA polymerase promoter are described in WO 95/16783 and WO 97/06250, and the *Arabidopsis* clpP promoter, which is described in WO 99/46394.

Other promoters, which are used for the strong expression of heterologous sequences in as many tissues as possible, in particular also in leaves, are, in addition to several of the abovementioned viral and bacterial promoters, preferably, plant promoters of actin or ubiquitin genes such as, for example, the rice actin1 promoter. Further examples of constitutive plant promoters are the sugarbeet V-ATPase promoters (WO 01/14572). Examples of synthetic constitutive promoters are the Super promoter (WO 95/14098) and promoters derived from G-boxes (WO 94/12015). If appropriate, chemical inducible promoters may furthermore also be used, compare EP-A 388186, EP-A 335528, WO 97/06268.

As already mentioned herein, further regulatory sequences, which may be expedient, if appropriate, also include sequences, which target the transport and/or the localization of the expression products. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell.

Preferred recipient plants are, as described above, in particular those plants, which can be transformed in a suitable manner. These include monocotyledonous and dicotyledonous plants. Plants which must be mentioned in particular are agriculturally useful plants such as cereals and grasses, for example *Triticum* spp., *Zea mays, Hordeum vulgare*, oats, *Secale cereale, Oryza sativa, Pennisetum glaucum, Sorghum bicolor, Triticale, Agrostis* spp., *Cenchrus ciliaris, Dactylis glomerata, Festuca arundinacea, Lolium* spp., *Medicago* spp. and *Saccharum* spp., legumes and oil crops, for example *Brassica juncea, Brassica napus, Glycine max, Arachis hypogaea, Gossypium hirsutum, Cicer arietinum, Helianthus annuus, Lens culinaris, Linum usitatissimum, Sinapis alba,*

*Trifolium repens* and *Vicia narbonensis*, vegetables and fruits, for example bananas, grapes, *Lycopersicon esculentum*, asparagus, cabbage, watermelons, kiwi fruit, *Solanum tuberosum*, *Beta vulgaris*, cassava and chicory, trees, for example *Coffea* species, *Citrus* spp., *Eucalyptus* spp., *Picea* spp., *Pinus* spp. and *Populus* spp., medicinal plants and trees, and flowers.

One embodiment of the present invention also relates to a method for generating a vector, which comprises the insertion, into a vector, of the nucleic acid molecule characterized herein, the nucleic acid molecule according to the invention or the expression cassette according to the invention. The vector can, for example, be introduced in to a cell, e.g. a microorganism or a plant cell, as described herein for the nucleic acid construct, or below under transformation or transfection or shown in the examples. A transient or stable transformation of the host or target cell is possible, however, a stable transformation is preferred. The vector according to the invention is preferably a vector, which is suitable for expressing the polypeptide according to the invention in a plant. The method can thus also encompass one or more steps for integrating regulatory signals into the vector, in particular signals, which mediate the expression in microorganisms or plants.

Accordingly, the present invention also relates to a vector comprising the nucleic acid molecule characterized herein as part of a nucleic acid construct suitable for plant expression or the nucleic acid molecule according to the invention.

The advantageous vectors of the invention comprise the nucleic acid molecules which encode proteins according to the invention, nucleic acid molecules which are used in the process, or nucleic acid construct suitable for plant expression comprising the nucleic acid molecules used, either alone or in combination with further genes such as the biosynthesis or regulatory genes of the fine chemical metabolism e.g. with the genes mentioned herein above. In accordance with the invention, the term "vector" refers to a nucleic acid molecule, which is capable of transporting another nucleic acid to which it is linked. One type of vector is a "plasmid", which means a circular double-stranded DNA loop into which additional DNA segments can be ligated. A further type of vector is a viral vector, it being possible to ligate additional nucleic acids segments into the viral genome. Certain vectors are capable of autonomous replication in a host cell into which they have been introduced (for example bacterial vectors with bacterial replication origin). Other preferred vectors are advantageously completely or partly integrated into the genome of a host cell when they are introduced into the host cell and thus replicate together with the host genome. Moreover, certain vectors are capable of controlling the expression of genes with which they are in operable linkage. In the present context, these vectors are referred to as "expression vectors". As mentioned above, they are capable of autonomous replication or may be integrated partly or completely into the host genome. Expression vectors, which are suitable for DNA recombination techniques usually, take the form of plasmids. In the present description, "plasmid" and "vector" can be used interchangeably since the plasmid is the most frequently used form of a vector. However, the invention is also intended to encompass these other forms of expression vectors, such as viral vectors, which exert similar functions. The term vector is furthermore also to encompass other vectors which are known to the skilled worker, such as phages, viruses such as SV40, CMV, TMV, transposons, IS elements, phasmids, phagemids, cosmids, and linear or circular DNA.

The recombinant expression vectors which are advantageously used in the process comprise the nucleic acid molecules according to the invention or the nucleic acid construct according to the invention in a form which is suitable for expressing, in a host cell, the nucleic acid molecules according to the invention or described herein. Accordingly, the the recombinant expression vectors comprise one or more regulatory signals selected on the basis of the host cells to be used for the expression, in operable linkage with the nucleic acid sequence to be expressed.

In a recombinant expression vector, "operable linkage" means that the nucleic acid molecule of interest is linked to the regulatory signals in such a way that expression of the nucleic acid molecule is possible: they are linked to one another in such a way that the two sequences fulfill the predicted function assigned to the sequence (for example in an in-vitro transcription/translation system, or in a host cell if the vector is introduced into the host cell).

The term "regulatory sequence" is intended to comprise promoters, enhancers and other expression control elements (for example polyadenylation signals. These regulatory sequences are described, for example, in Goeddel: Gene Expression Technology: Methods in Enzymology 185, Academic Press, San Diego, Calif. (1990), or see: Gruber and Crosby, in: Methods in Plant Molecular Biology and Biotechnolgy, CRC Press, Boca Raton, Fla., Ed.: Glick and Thompson, chapter 7, 89-108, including the references cited therein. Regulatory sequences encompass those, which control the constitutive expression of a nucleotide sequence in many types of host cells and those which control the direct expression of the nucleotide sequence in specific host cells only, and under specific conditions. The skilled worker knows that the design of the expression vector may depend on factors such as the selection of the host cell to be transformed, the extent to which the desired protein is expressed, and the like. A preferred selection of regulatory sequences is described above, for example promoters, terminators, enhancers and the like. The term regulatory sequence is to be considered as being encompassed by the term regulatory signal. Several advantageous regulatory sequences, in particular promoters and terminators are described above. In general, the regulatory sequences described as advantageous for nucleic acid construct suitable for expression are also applicable for vectors.

The recombinant expression vectors used can be designed specifically for the expression, in prokaryotic and/or eukaryotic cells, of nucleic acid molecules used in the process. This is advantageous since intermediate steps of the vector construction are frequently carried out in microorganisms for the sake of simplicity. For example, the genes according to the invention and other genes can be expressed in bacterial cells, insect cells (using baculovirus expression vectors), yeast cells and other fungal cells [Romanos (1992), Yeast 8:423-488; van den Hondel, (1991), in: More Gene Manipulations in Fungi, J. W. Bennet & L. L. Lasure, Ed., pp. 396-428: Academic Press: San Diego; and van den Hondel, C. A. M. J. J. (1991), in: Applied Molecular Genetics of Fungi, Peberdy, J. F., et al., Ed., pp. 1-28, Cambridge University Press: Cambridge], algae [Falciatore et al., 1999, Marine Biotechnology. 1, 3:239-251] using vectors and following a transformation method as described in WO 98/01572, and preferably in cells of multi-celled plants [see Schmidt, R. and Willmitzer, L. (1988) Plant Cell Rep.: 583-586; Plant Molecular Biology and Biotechnology, C Press, Boca Raton, Fla., chapter 6/7, pp. 71-119 (1993); F. F. White, in: Transgenic Plants, Bd. 1, Engineering and Utilization, Ed.: Kung and R. Wu, Academic Press (1993), 128-43; Potrykus, Annu. Rev. Plant Physiol. Plant Molec. Biol. 42 (1991), 205-225 (and references cited therein)]. Suitable host cells are furthermore discussed in Goeddel, Gene Expression Technology: Methods in Enzymology 185, Academic Press, San Diego, Calif. (1990). As an alternative, the sequence of the recombinant expression vector can be transcribed and translated in vitro, for example using T7 promotor-regulatory sequences and T7 polymerase.

Proteins can be expressed in prokaryotes using vectors comprising constitutive or inducible promoters, which control the expression of fusion proteins or nonfusion proteins. Typical fusion expression vectors are, inter alia, pGEX (Pharmacia Biotech Inc; Smith, D. B., and Johnson, K. S. (1988) Gene 67:31-40), pMAL (New England Biolabs, Beverly, Mass.) and pRIT5 (Pharmacia, Piscataway, N.J.), in which glutathione-S-transferase (GST), maltose-E-binding protein or protein A is fused with the recombinant target protein. Examples of suitable inducible nonfusion E. coli expression vectors are, inter alia, pTrc (Amann et al. (1988) Gene 69:301-315) and pET 11d [Studier et al., Gene Expression Technology: Methods in Enzymology 185, Academic Press, San Diego, Calif. (1990) 60-89]. The target gene expression of the pTrc vector is based on the transcription of a hybrid trp-lac fusion promoter by the host RNA polymerase. The target gene expression from the pET 11d vector is based on the transcription of a T7-gn10-lac fusion promoter, which is mediated by a coexpressed viral RNA polymerase (T7 gn1). This viral polymerase is provided by the host strains BL21 (DE3) or HMS174 (DE3) by a resident λ-prophage, which harbors a T7 gn1 gene under the transcriptional control of the lacUV 5 promoter.

Other vectors which are suitable in prokaryotic organisms are known to the skilled worker; these vectors are for example in *E. coli* pLG338, pACYC184, the pBR series, such as pBR322, the pUC series such as pUC18 or pUC19, the M113mp series, pKC30, pRep4, pHS1, pHS2, pPLc236, pMBL24, pLG200, pUR290, pIN-III$^{113}$-B1, λgt11 or pBdCl, in *Streptomyces* pIJ101, pIJ364, pIJ702 or pIJ361, in *Bacillus* pUB 110, pC194 or pBD214, in *Corynebacterium* pSA77 or pAJ667.

In a further embodiment, the expression vector is a yeast expression vector. Examples of vectors for expression in the yeasts *S. cerevisiae* encompass pYeDesaturasec1 (Baldari et al. (1987) Embo J. 6:229-234), pMFa (Kurjan and Herskowitz (1982) Cell 30:933-943), pJRY88 (Schultz et al. (1987) Gene 54:113-123) and pYES2 (Invitrogen Corporation, San Diego, Calif.). Vectors and methods for the construction of vectors which are suitable for use in other fungi, such as the filamentous fungi, encompass those which are described in detail in: van den Hondel, C. A. M. J. J. [(1991), J. F. Peberdy, Ed., pp. 1-28, Cambridge University Press: Cambridge; or in: More Gene Manipulations in Fungi; J. W. Bennet & L. L. Lasure, Ed., pp. 396-428: Academic Press: San Diego]. Examples of other suitable yeast vectors are 20□M, pAG-1, YEp6, YEp13 or pEMBLYe23.

Further vectors, which may be mentioned by way of example, are pALS1, pIL2 or pBB116 in fungi or pLGV23, pGHlac$^+$, pBIN19, pAK2004 or pDH51 in plants.

As an alternative, the nucleic acid sequences can be expressed in insect cells using baculovirus expression vectors. Baculovirus vectors which are available for expressing proteins in cultured insect cells (for example Sf9 cells) encompass the pAc series (Smith et al. (1983) Mol. Cell Biol. 3:2156-2165) and the pVL series (Lucklow and Summers (1989) Virology 170:31-39).

The abovementioned vectors are only a small overview of potentially suitable vectors. Further plasmids are known to the skilled worker and are described, for example, in: Cloning Vectors (Ed. Pouwels, P. H., et al., Elsevier, Amsterdam-New York-Oxford, 1985, ISBN 0 444 904018). Further suitable expression systems for prokaryotic and eukaryotic cells, see the chapters 16 and 17 by Sambrook, J., Fritsch, E. F., and Maniatis, T., Molecular Cloning: A Laboratory Manual, 2nd Edition, Cold Spring Harbor Laboratory, Cold Spring Harbor Laboratory Press, Cold Spring Harbor, N.Y., 1989.

Accordingly, one embodiment of the invention relates to a vector where the nucleic acid molecule according to the invention is linked operably to regulatory sequences which permit the expression in a prokaryotic or eukaryotic or in a prokaryotic and eukaryotic host.

Accordingly, one embodiment of the invention relates to a host cell, which has been transformed stably or transiently with the vector according to the invention or the nucleic acid molecule according to the invention or the nucleic acid construct according to the invention.

Depending on the host organism, the organisms used in the process according to the invention are cultured or grown in a manner with which the skilled worker is familiar. As a rule, microorganisms are grown in a liquid medium comprising a carbon source, usually in the form of sugars, a nitrogen source, usually in the form of organic nitrogen sources such as yeast extract or salts such as ammonium sulfate, trace elements such as iron salts, manganese salts, magnesium salts, and, if appropriate, vitamins, at temperatures between 0° C. and 100° C., preferably between 10° C. and 60° C., while passing in oxygen. In the event the microorganism is anaerobe, no oxygen is blown through the culture medium. The pH value of the liquid nutrient medium may be kept constant, that is to say regulated during the culturing phase, or not. The organisms may be cultured batchwise, semibatchwise or continuously. Nutrients may be provided at the beginning of the fermentation or fed in semicontinuously or continuously.

The fine chemical produced can be isolated from the organism by methods with which the skilled worker is familiar. For example via extraction, salt precipitation and/or ion-exchange chromatography etc. To this end, the organisms may be disrupted beforehand. The process according to the invention can be conducted batchwise, semibatchwise or continuously. A summary of known culture and isolation techniques can be found in the textbook by Chmiel [Bioprozeβtechnik 1, Einführung in die Bioverfahrenstechnik (Gustav Fischer Verlag, Stuttgart, 1991)], Demain et al. (Industrial Microbiology and Biotechnology, second edition, ASM Press, Washington, D.C., 1999, ISBN 1-55581-128-0] or in the textbook by Storhas [Bioreaktoren und periphere Einrichtungen (Vieweg Verlag, Braunschweig/Wiesbaden, 1994)].

In one embodiment, the present invention relates to a polypeptide encoded by the nucleic acid molecule according to the present invention, preferably conferring an increase in the fine chemical content in an organism or cell after increasing the expression or activity.

The present invention also relates to a process for the production of a polypeptide according to the present invention, the polypeptide being expressed in a host cell according to the invention, preferably in a microorganism or a transgenic plant cell.

In one embodiment, the nucleic acid molecule used in the process for the production of the polypeptide is derived from a microorganism, preferably from a prokaryotic or protozoic cell with a eukaryotic organism as host cell. E.g., in one embodiment the polypeptide is produced in a plant cell or plant with a nucleic acid molecule derived from a prokaryote or a fungus or an alga or another microorganismus but not from plant.

The skilled worker knows that protein and DNA expressed in different organisms differ in many respects and properties, e.g. DNA modulation and imprinting, such as methylation or post-translational modification, as for example glucosylation, phosphorylation, acetylation, myristoylation, ADP-ribosylation, farnesylation, carboxylation, sulfation, ubiquination, etc. though having the same coding sequence. Preferably, the cellular expression control of the corresponding protein differs accordingly in the control mechanisms controlling the activity and expression of an endogenous protein or another eukaryotic protein. One major difference between proteins expressed in prokaryotic or eukaryotic organisms is the amount and pattern of glycosylation. For example in E. coli there are no glycosylated proteins. Proteins expressed in yeasts have high mannose content in the glycosylated proteins, whereas in plants the glycosylation pattern is complex.

The polypeptide of the present invention is preferably produced by recombinant DNA techniques. For example, a nucleic acid molecule encoding the protein is cloned into a vector (as described above), the vector is introduced into a host cell (as described above) and said polypeptide is expressed in the host cell. Said polypeptide can then be isolated from the cells by an appropriate purification scheme using standard protein purification techniques. Alternative to recombinant expression, the polypeptide or peptide of the present invention can be synthesized chemically using standard peptide synthesis techniques.

Moreover, native polypeptides conferring the increase of the fine chemical in an organism or part thereof can be isolated from cells (e.g., endothelial cells), for example using the antibody of the present invention as described below, in particular, an anti-YNL090W protein antibody or an antibody against polypeptides as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394, which can be produced by standard techniques utilizing the polypeptid of the present invention or fragment thereof, i.e., the polypeptide of this invention. Preferred are monoclonal antibodies.

In one embodiment, the present invention relates to a polypeptide having the amino acid sequence encoded by a nucleic acid molecule of the invention or obtainable by a process of the invention. Said polypeptide confers preferably the aforementioned activity, in particular, the polypeptide confers the increase of the fine chemical in a cell or an organsim or a part thereof after increasing the cellular activity, e.g. by increasing the expression or the specific activity of the polypeptide.

In one embodiment, the present invention relates to a polypeptide having the sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or as coded by the nucleic acid molecule as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 or functional homologues thereof.

In one advantageous embodiment, in the method of the present invention the activity of a polypeptide is increased comprising or consisting of the consensus sequence as depicted in SEQ ID NO: 47, SEQ ID NO: 48, SEQ ID NO: 49, SEQ ID NO: 50, SEQ ID NO: 51, SEQ ID NO: 52, SEQ ID NO: 397, SEQ ID NO: 398, SEQ ID NO: 399 and/or SEQ ID NO: 400 and in one another embodiment, the present invention relates to a polypeptide comprising or consisting of the consensus sequence as depicted in SEQ ID NO: 47, SEQ ID NO: 48, SEQ ID NO: 49, SEQ ID NO: 50, SEQ ID NO: 51, SEQ ID NO: 52, SEQ ID NO: 397, SEQ ID NO: 398, SEQ ID NO: 399 and/or SEQ ID NO: 400 whereby 20 or less, preferably 15 or 10, preferably 9, 8, 7, or 6, more preferred 5 or 4, even more preferred 3, even more preferred 2, even more preferred 1, most preferred 0 of the amino acids positions indicated can be replaced by any amino acid.

In one embodiment not more than 15%, preferably 10%, even more preferred 5%, 4%, 3%, or 2%, most preferred 1% or 0% of the amino acid position indicated by a letter are/is replaced another amino acid.

In one embodiment 20 or less, preferably 15 or 10, preferably 9, 8, 7, or 6, more preferred 5 or 4, even more preferred 3, even more preferred 2, even more preferred 1, most preferred 0 amino acids are inserted into the consensus sequence.

The consensus sequences of specified domains were derived from a multiple alignment of all sequences. The consensus sequences are disclosed under SEQ ID NO: 47, SEQ ID NO: 48, SEQ ID NO: 49, SEQ ID NO: 50, SEQ ID NO: 51, SEQ ID NO: 52, SEQ ID NO: 397, SEQ ID NO: 398, SEQ ID NO: 399 and/or SEQ ID NO: 400. The letters represent the three letter amino acid code and indicate that the amino acids are conserved in all aligned proteins. The letter Xaa stands for amino acids, which are not conserved in all sequences. In some cases of the sequences as depicted in SEQ ID NO: 47, SEQ ID NO: 48, SEQ ID NO: 49, SEQ ID NO: 50, SEQ ID NO: 51, SEQ ID NO: 52, SEQ ID NO: 397, SEQ ID NO: 398, SEQ ID NO: 399 and/or SEQ ID NO: 400 preferred amino acids are mentioned in the sequence protocol in others all natural amino acids are possible. FIG. 1 shows an alignment with part of the sequences in the one letter amino acid code. The conserved sequences are framed.

The alignment was performed either with the Software AlignX (Sep. 25, 2002) a component of Vector NTI Suite 8.0, InforMax™, Invitrogen™ life science software, U.S. Main Office, 7305 Executive Way, Frederick, Md. 21704, USA with the following settings: For pairwise alignments: gap opening penalty: 10.0; gap extension penality 0.1. For multiple alignments: Gap opening penalty: 10.0; Gap extension penalty: 0.1; Gap separation penalty range: 8; Residue substitution matrix: blosum62; Hydrophilic residues: G P S N D Q E K R; Transition weighting: 0.5; Consensus calculation options: Residue fraction for consensus: 1 or preferably the percent sequence identity between two nucleic acid or polypeptide sequences was determined using the Vector NTI 6.0 (PC) software package (InforMax, 7600 Wisconsin Ave., Bethesda, Md. 20814). A gap opening penalty of 15 and a gap extension penalty of 6.66 are used for determining the percent identity of two nucleic acids. A gap opening penalty of 10 and a gap extension penalty of 0.1 are used for determining the percent identity of two polypeptides. All other parameters are set at the default settings. For purposes of a multiple alignment (Clustal W algorithm), the gap opening penalty is 10, and the gap extension penalty is 0.05 with blosum62 matrix.

In one advantageous embodiment, the method of the present invention comprises the increasing of a polypeptide comprising or consisting of plant or microorganism specific consensus sequences.

In one embodiment, said polypeptide of the invention distinguishes over the sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 by one or more amino acids. In one embodiment, polypeptide distinguishes form the sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 by more than 5, 6, 7, 8 or 9 amino acids, preferably by more than 10, 15, 20, 25 or 30 amino acids, even more preferred are more than 40, 50, or 60 amino acids and, preferably, the sequence of the polypeptide of the invention distinguishes from the sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 by not more than 80% or 70% of the amino acids, preferably not more than 60% or 50%, more preferred not more than 40% or 30%, even more preferred not more than 20% or 10%. In an other embodiment, said polypeptide of the invention does not consist of the sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394.

In one embodiment, the polypeptide of the invention comprises any one of the sequences not known to the public before. In one embodiment, the polypeptide of the invention orginates from a non-plant cell, in particular from a microorganism, and was expressed in a plant cell. In one embodiment, the present invention relates to a polypeptide encoded by the nucleic acid molecule of the invention or used in the process of the invention for which an activity has not been described yet.

In one embodiment, the invention relates to polypeptide conferring an increase in the fine chemical in an organism or part being encoded by the nucleic acid molecule of the invention or used in the process of the invention and having a sequence which distinguishes from the sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 by one or more amino acids. In an other embodiment, said polypeptide of the invention does not consist of the sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394. In a further embodiment, said polypeptide of the present invention is less than 100%, 99.999%, 99.99%, 99.9% or 99% identical. In one embodiment, said polypeptide does not consist of the sequence encoded by the nucleic acid molecules as depicted in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393.

In one embodiment, the present invention relates to a polypeptide having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 and which distinguishes over the aforementioned sequences by one or more amino acids, preferably by more than 5, 6, 7, 8 or 9 amino acids, preferably by more than 10, 15, 20, 25 or 30 amino acids, even more preferred are more than 40, 50, or 60 amino acids but even more preferred by less than 70% of the amino acids, more preferred by less than 50%, even more preferred my less than 30% or 25%, more preferred are 20% or 15%, even more preferred are less than 10%.

The terms "protein" and "polypeptide" used in this application are interchangeable. "Polypeptide" refers to a polymer of amino acids (amino acid sequence) and does not refer to a specific length of the molecule. Thus peptides and oligopeptides are included within the definition of polypeptide. This term does also refer to or include post-translational modifications of the polypeptide, for example, glycosylations, acetylations, phosphorylations and the like. Included within the definition are, for example, polypeptides containing one or more analogs of an amino acid (including, for example, unnatural amino acids, etc.), polypeptides with substituted linkages, as well as other modifications known in the art, both naturally occurring and non-naturally occurring.

Preferably, the polypeptide is isolated. An "isolated" or "purified" protein or nucleic acid molecule or biologically active portion thereof is substantially free of cellular material when produced by recombinant DNA techniques or chemical precursors or other chemicals when chemically synthesized. The language "substantially free of cellular material" includes preparations of the polypeptide of the invention in which the protein is separated from cellular components of the cells in which it is naturally or recombinantly produced. In one embodiment, the language "substantially free of cellular material" includes preparations having less than about 30% (by dry weight) of "contaminating protein", more preferably less than about 20% of "contaminating protein", still more preferably less than about 10% of "contaminating protein", and most preferably less than about 5% "contaminating protein". The term "Contaminating protein" relates to polypeptides, which are not polypeptides of the present invention. When the polypeptide of the present invention or biologically active portion thereof is recombinantly produced, it is also preferably substantially free of culture medium, i.e., culture medium represents less than about 20%, more preferably less than about 10%, and most preferably less than about 5% of the volume of the protein preparation. The language "substantially free of chemical precursors or other chemicals" includes preparations in which the polypeptide of the present invention is separated from chemical precursors or other chemicals, which are involved in the synthesis of the protein. The language "substantially free of chemical precursors or other chemicals" includes preparations having less than about 30% (by dry weight) of chemical precursors or non-polypeptide of the invention chemicals, more preferably less than about 20% chemical precursors or non-polypeptide of the invention chemicals, still more preferably less than about 10% chemical precursors or non-polypeptide of the invention-chemicals, and most preferably less than about 5% chemical precursors or non-polypeptide of the invention-chemicals. In preferred embodiments, isolated proteins or biologically active portions thereof lack contaminating proteins from the same organism from which the polypeptide of the present invention is derived. Typically, such proteins are produced by recombinant techniques.

A polypeptide of the invention can participate in the process of the present invention. The polypeptide or a portion thereof comprises preferably an amino acid sequence which is sufficiently homologous to an amino acid sequence as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 such that the protein or portion thereof maintains the ability to confer the activity of the present invention. The portion of the protein is preferably a biologically active portion as described herein. Preferably, the polypeptide used in the process of the invention has an amino acid sequence identical as shown in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394.

Further, the polypeptide can have an amino acid sequence which is encoded by a nucleotide sequence which hybridizes, preferably hybridizes under stringent conditions as described above, to a nucleotide sequence of the nucleic acid molecule of the present invention. Accordingly, the polypeptide has an amino acid sequence which is encoded by a nucleotide sequence that is at least about 35%, 40%, 45%, 50%, 55%, 60%, 65% or 70%, preferably at least about 75%, 80%, 85% or 90, and more preferably at least about 91%, 92%, 93%, 94% or 95%, and even more preferably at least about 96%, 97%, 98%, 99% or more homologous to one of the amino acid sequences of SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394. The preferred polypeptide of the present invention preferably possesses at least one of the activities according to the invention and described herein. A preferred polypeptide of the present invention includes an amino acid sequence encoded by a nucleotide sequence which hybridizes, preferably hybridizes under stringent conditions, to a nucleotide sequence of SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 or which is homologous thereto, as defined above.

Accordingly the polypeptide of the present invention can vary from SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 in amino acid sequence due to natural variation or mutagenesis, as described in detail herein. Accordingly, the polypeptide comprise an amino acid sequence which is at least about 35%, 40%, 45%, 50%, 55%, 60%, 65% or 70%, preferably at least about 75%, 80%, 85% or 90, and more preferably at least about 91%, 92%, 93%, 94% or 95%, and most preferably at least about 96%, 97%, 98%, 99% or more homologous to an entire amino acid sequence of SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394.

For the comparison of amino acid sequences the same algorithms as described above or nucleic acid sequences can be used. Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the perentages of sequence homology are done with the program Gap over the whole range of the sequences. The following standard adjustments for the comparison of amino acid sequences were used: gap weight: 8, length weight: 2, average match: 2.912, average mismatch: −2.003.

Biologically active portions of an polypeptide of the present invention include peptides comprising amino acid sequences derived from the amino acid sequence of the polypeptide of the present invention or used in the process of the present invention, e.g., the amino acid sequence shown in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 or the amino acid sequence of a protein homologous thereto, which include fewer amino acids than a full length polypeptide of the present invention or used in the process of the present invention or the full length protein which is homologous to an polypeptide of the present invention or used in the process of the present invention depicted herein, and exhibit at least one activity of polypeptide of the present invention or used in the process of the present invention.

Typically, biologically (or immunologically) active portions i.e. peptides, e.g., peptides which are, for example, 5, 10, 15, 20, 30, 35, 36, 37, 38, 39, 40, 50, 100 or more amino acids in length comprise a domain or motif with at least one activity or epitope of a polypeptide of the present invention or used in the process of the present invention. Moreover, other biologically active portions, in which other regions of the polypeptide are deleted, can be prepared by recombinant techniques and evaluated for one or more of the activities described herein.

Manipulation of the nucleic acid molecule of the invention may result in the production of proteins having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 and having differences from said aforementioned wild-type proteins. These proteins may be improved in efficiency or activity, may be present in greater numbers in the cell than is usual, or may be decreased in efficiency or activity in relation to the wild type protein.

Any mutagenesis strategies for the polypeptide of the present invention or the polypeptide used in the process of the present invention to result in increasing said activity are not meant to be limiting; variations on these strategies will be readily apparent to one skilled in the art. Using such strategies, and incorporating the mechanisms disclosed herein, the nucleic acid molecule and polypeptide of the invention may be utilized to generate plants or parts thereof, expressing wildtype proteins of the invention or mutated protein encoding nucleic acid molecules and polypeptide molecules of the invention such that the yield, production, and/or efficiency of production of a desired compound is improved.

This desired compound may be any natural product of plants, which includes the final products of biosynthesis pathways and intermediates of naturally-occurring metabolic pathways, as well as molecules which do not naturally occur in the metabolism of said cells, but which are produced by a said cells of the invention. Preferably, the compound is a composition of amino acids or a recovered amino acid, in particular, the fine chemical, free or in protein-bound form.

The invention also provides chimeric or fusion proteins.

As used herein, an "chimeric protein" or "fusion protein" comprises an polypeptide operatively linked to a polypeptide which does not confer above-mentioned activity, in particulare, which does not confer an increase of content of the fine chemical in a cell or an organism or a part thereof, if its activity is increased.

In one embodiment, a protein (=polypeptide)" having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394 refers to a polypeptide having an amino acid sequence corresponding to the polypeptide of the invention or used in the process of the invention, whereas a "non-polypeptide of the invention" or "other polypeptide" refers to a polypeptide having an amino acid sequence corresponding to a protein which is not substantially homologous a polypeptide of the invention, preferably which is not substantially homologous to a polypeptide having the biological activity represented by a protein as depicted in SEQ ID NO: 2, 4, 6, 8, 10, 12, 14, 16, 18, 20, 22, 24, 26, 28, 30, 32, 34, 36, 38, 40, 42, 44, 46, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392 or 394, e.g., a protein which does not confer the activity described herein and which is derived from the same or a different organism.

Within the fusion protein, the term "operatively linked" is intended to indicate that the polypeptide of the invention or a polypeptide used in the process of the invention and the "other polypeptide" or a part thereof are fused to each other so that both sequences fulfil the proposed function addicted to the sequence used. The "other polypeptide" can be fused to the N-terminus or C-terminus of the polypeptide of the invention or used in the process of the invention. For example, in one embodiment the fusion protein is a GST-LMRP fusion protein in which the sequences of the polypeptide of the invention or the polypeptide used in the process of the invention are fused to the C-terminus of the GST sequences. Such fusion proteins can facilitate the purification of recombinant polypeptides of the invention or a poylpeptide usefull in the process of the invention.

In another embodiment, the fusion protein is a polypeptide of the invention or a polypeptide used in the process of the invention containing a heterologous signal sequence at its N-terminus. In certain host cells (e.g., mammalian host cells), expression and/or secretion of a polypeptide of the invention or a poylpeptide used in the process of the invention can be increased through use of a heterologous signal sequence. As already mentioned above, targeting sequences, are required for targeting the gene product into specific cell compartment (for a review, see Kermode, Crit. Rev. Plant Sci. 15, 4 (1996) 285-423 and references cited therein), for example into the vacuole, the nucleus, all types of plastids, such as amyloplasts, chloroplasts, chromoplasts, the extracellular space, the mitochondria, the endoplasmic reticulum, elaioplasts, peroxisomes, glycosomes, and other compartments of cells or extracellular. Sequences, which must be mentioned in this context are, in particular, the signal-peptide- or transit-peptide-encoding sequences which are known per se. For example, plastid-transit-peptide-encoding sequences enable the targeting of the expression product into the plastids of a plant cell. Targeting sequences are also known for eukaryotic and to a lower extent for prokaryotic organisms and can advantageously be operable linked with the nucleic acid molecule of the present invention to achieve an expression in one of said compartments or extracellular.

Preferably, a chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. The fusion gene can be synthesized by conventional techniques including automated DNA synthesizers. Alternatively, PCR amplification of gene fragments can be carried out using anchor primers, which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a GST polypeptide). The nucleic acid molecule of the invention can be cloned into such an expression vector such that the fusion moiety is linked in-frame to the encoded protein.

Furthermore, folding simulations and computer redesign of structural motifs of the protein of the invention can be performed using appropriate computer programs (Olszewski, Proteins 25 (1996), 286-299; Hoffman, Comput. Appl. Biosci. 11 (1995), 675-679). Computer modeling of protein folding can be used for the conformational and energetic analysis of detailed peptide and protein models (Monge, J. Mol. Biol. 247 (1995), 995-1012; Renouf, Adv. Exp. Med. Biol. 376 (1995), 37-45). The appropriate programs can be used for the identification of interactive sites the polypeptide of the invention or polypeptides used in the process of the invention and its substrates or binding factors or other interacting proteins by computer assistant searches for complementary peptide sequences (Fassina, Immunomethods (1994), 114-120). Further appropriate computer systems for the design of protein and peptides are described in the prior art, for example in Berry, Biochem. Soc. Trans. 22 (1994), 1033-1036; Wodak, Ann. N.Y. Acad. Sci. 501 (1987), 1-13; Pabo, Biochemistry 25 (1986), 5987-5991. The results obtained from the above-described computer analysis can be used for, e.g., the preparation of peptidomimetics of the protein of the invention or fragments thereof. Such pseudopeptide analogues of the, natural amino acid sequence of the protein may very efficiently mimic the parent protein (Benkirane, J. Biol. Chem. 271 (1996), 33218-33224). For example, incorporation of easily available achiral Q-amino acid residues into a protein of the invention or a fragment thereof results in the substitution of amide bonds by polymethylene units of an aliphatic chain, thereby providing a convenient strategy for constructing a peptidomimetic (Banerjee, Biopolymers 39 (1996), 769-777).

Superactive peptidomimetic analogues of small peptide hormones in other systems are described in the prior art (Zhang, Biochem. Biophys. Res. Commun. 224 (1996), 327-331). Appropriate peptidomimetics of the protein of the present invention can also be identified by the synthesis of peptidomimetic combinatorial libraries through successive amide alkylation and testing the resulting compounds, e.g., for their binding and immunological properties. Methods for the generation and use of peptidomimetic combinatorial libraries are described in the prior art, for example in Ostresh, Methods in Enzymology 267 (1996), 220-234 and Dorner, Bioorg. Med. Chem. 4 (1996), 709-715.

Furthermore, a three-dimensional and/or crystallographic structure of the protein of the invention can be used for the design of peptidomimetic inhibitors of the biological activity of the protein of the invention (Rose, Biochemistry 35 (1996), 12933-12944; Rutenber, Bioorg. Med. Chem. 4 (1996), 1545-1558).

Furthermore, a three-dimensional and/or crystallographic structure of the protein of the invention and the identification of interactive sites the polypeptide of the invention and its substrates or binding factors can be used for design of mutants with modulated binding or turn over activities. For example, the active center of the polypeptide of the present invention can be modelled and amino acid residues participating in the catalytic reaction can be modulated to increase or decrease the binding of the substrate to activate or improve the polypeptide. The identification of the active center and the amino acids involved in the catalytic reaction facilitates the screening for mutants having an increased activity.

One embodiment of the invention also relates to an antibody, which binds specifically to the polypeptide according to the invention or parts, i.e. specific fragments or epitopes of such a protein.

The antibodies of the invention can be used to identify and isolate the polypeptide according to the invention and encoding genes in any organism, preferably plants, prepared in plants described herein. These antibodies can be monoclonal antibodies, polyclonal antibodies or synthetic antibodies as well as fragments of antibodies, such as Fab, Fv or scFv fragments etc. Monoclonal antibodies can be prepared, for example, by the techniques as originally described in Köhler and Milstein, Nature 256 (1975), 495, and Galfr6, Meth. Enzymol. 73 (1981), 3, which comprise the fusion of mouse myeloma cells to spleen cells derived from immunized mammals.

Furthermore, antibodies or fragments thereof to the aforementioned peptides can be obtained by using methods, which are described, e.g., in Harlow and Lane "Antibodies, A Laboratory Manual", CSH Press, Cold Spring Harbor, 1988. These antibodies can be used, for example, for the immunoprecipitation and immunolocalization of proteins according to the invention as well as for the monitoring of the synthesis of such proteins, for example, in recombinant organisms, and for the identification of compounds interacting with the protein according to the invention. For example, surface plasmon resonance as employed in the BIAcore system can be used to increase the efficiency of phage antibodies selections, yielding a high increment of affinity from a single library of phage antibodies, which bind to an epitope of the protein of the invention (Schier, Human Antibodies Hybridomas 7 (1996), 97-105; Malmborg, J. Immunol. Methods 183 (1995), 7-13). In many cases, the binding phenomena of antibodies to antigens are equivalent to other ligand/anti-ligand binding.

In one embodiment, the present invention relates to an antisense nucleic acid molecule comprising the complementary sequence of the nucleic acid molecule of the present invention.

Methods to modify the expression levels and/or the activity are known to persons skilled in the art and include for instance overexpression, co-suppression, the use of ribozymes, sense and anti-sense strategies or other gene silencing approaches like RNA interference (RNAi) or promoter methylation. "Sense strand" refers to the strand of a double-stranded DNA molecule that is homologous to an mRNA transcript thereof. The "anti-sense strand" contains an inverted sequence, which is complementary to that of the "sense strand".
In addition the expression levels and/or the activity can be modified by the introduction of mutations in the regulatory or coding regions of the nucleic acids of the invention. Furthermore antibodies can be expressed which specifically binds to a polypeptide of interest and thereby blocks it acitivity. The protein-binding factors can, for example, also be aptamers [Famulok M and Mayer G (1999) Curr. Top Microbiol. Immunol. 243:123-36] or antibodies or antibody fragments or single-chain antibodies. Obtaining these factors has been described, and the skilled worker is familiar therewith. For example, a cytoplasmic scFv antibody has been employed for modulating activity of the phytochrome A protein in genetically modified tobacco plants [Owen M et al. (1992) Biotechnology (NY) 10(7): 790-794; Franken E et al. (1997) Curr. Opin. Biotechnol. 8(4): 411-416; Whitelam (1996) Trend Plant Sci. 1: 286-272].

An "antisense" nucleic acid molecule comprises a nucleotide sequence, which is complementary to a "sense" nucleic acid molecule encoding a protein, e.g., complementary to the coding strand of a double-stranded cDNA molecule or complementary to an encoding mRNA sequence. Accordingly, an antisense nucleic acid molecule can bond via hydrogen bonds to a sense nucleic acid molecule. The antisense nucleic acid molecule can be complementary to an entire coding strand of a nucleic acid molecule conferring the expression of the polypeptide of the invention or used in the process of the present invention, as the nucleic acid molecule of the invention coding strand, or to only a portion thereof. Accordingly, an antisense nucleic acid molecule can be antisense to a "coding region" of the coding strand of a nucleotide sequence of a nucleic acid molecule of the present invention. The term "coding region" refers to the region of the nucleotide sequence comprising codons, which are translated into amino acid residues. Further, the antisense nucleic acid molecule is antisense to a "noncoding region" of the coding strand of a nucleotide sequence encoding the polypeptide of the invention or a polypeptide used in the process of the invention. The term "noncoding region" refers to 5' and 3' sequences which flank the coding region that are not translated into a polypeptide, i.e., also referred to as 5' and 3' untranslated regions (5'-UTR or 3'-UTR).

Given the coding strand sequences encoding the polypeptide of the present invention antisense nucleic acid molecules of the invention can be designed according to the rules of Watson and Crick base pairing.

The antisense nucleic acid molecule can be complementary to the entire coding region of the mRNA encoding the nucleic acid molecule ot the invention or used in the process of the present invention, but can also be an oligonucleotide which is antisense to only a portion of the coding or noncoding region of said mRNA. For example, the antisense oligonucleotide can be complementary to the region surrounding the translation start site of said mRNA. An antisense oligonucleotide can be, for example, about 5, 10, 15, 20, 25, 30, 35, 40, 45, 50, 100 or 200 nucleotides in length. An antisense nucleic acid molecule of the invention can be constructed using chemical synthesis and enzymatic ligation reactions using procedures known in the art. For example, an antisense nucleic acid molecule (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid molecule has been subcloned in an antisense orientation (i.e., RNA transcribed from the inserted nucleic acid molecule will be of an antisense orientation to a target nucleic acid molecule of interest, described further in the following subsection).

The antisense nucleic acid molecules of the invention are typically administered to a cell or generated in situ such that they hybridize with or bind to cellular mRNA and/or genomic DNA encoding a polypeptide of the invention having aforementioned the fine chemical increasing activity to thereby inhibit expression of the protein, e.g., by inhibiting transcription and/or translation.

The hybridization can be by conventional nucleotide complementarity to form a stable duplex, or, for example, in the case of an antisense nucleic acid molecule which binds to DNA duplexes, through specific interactions in the major groove of the double helix. The antisense nucleic acid molecule can also be delivered to cells using the vectors described herein. To achieve sufficient intracellular concentrations of the antisense molecules, vector in which the antisense nucleic acid molecule is placed under the control of a strong prokaryotic, viral, or eukaryotic including plant promoters are preferred.

In a further embodiment, the antisense nucleic acid molecule of the invention can be an α-anomeric nucleic acid molecule. A α-anomeric nucleic acid molecule forms specific double-stranded hybrids with complementary RNA in which, contrary to the usual units, the strands run parallel to each other (Gaultier et al. (1987) Nucleic Acids. Res. 15:6625-6641). The antisense nucleic acid molecule can also comprise a 2'-o-methylribonucleotide (Inoue et al. (1987) Nucleic Acids Res. 15:6131-6148) or a chimeric RNA-DNA analogue (Inoue et al. (1987) FEBS Lett. 215:327-330).

Further the antisense nucleic acid molecule of the invention can be also a ribozyme. Ribozymes are catalytic RNA molecules with ribonuclease activity, which are capable of cleaving a single-stranded nucleic acid, such as an mRNA, to which they have a complementary region. Thus, ribozymes (e.g., hammerhead ribozymes (described in Haselhoff and Gerlach (1988) Nature 334:585-591)) can be used to catalytically cleave mRNA transcripts encoding the polypeptide of the invention to thereby inhibit translation of said mRNA. A ribozyme having specificity for a nucleic acid molecule encoding the polypeptide of the invention or used in the process of the invention can be designed based upon the nucleotide sequence of the nucleic acid molecule of the invention or coding a protein used in the process of the invention or on the basis of a heterologous sequence to be isolated according to methods taught in this invention. For example, a derivative of a Tetrahymena L-19 IVS RNA can be constructed in which the nucleotide sequence of the active site is complementary to the nucleotide sequence to be cleaved in an encoding mRNA. See, e.g., Cech et al. U.S. Pat. No. 4,987,071 and Cech et al. U.S. Pat. No. 5,116,742. Alternatively, mRNA encoding the polypeptide of the invention or a polypeptide used in the process of the invention can be used to select a catalytic RNA having a specific ribonuclease activity from a pool of RNA molecules. See, e.g., Bartel, D. and Szostak, J. W. (1993) Science 261:1411-1418.

The antisense molecule of the present invention comprises also a nucleic acid molecule comprising a nucleotide sequences complementary to the regulatory region of an nucleotide sequence encoding the natural occurring polypeptide of the invention, e.g. the polypeptide sequences shown in the sequence listing, or identified according to the methods described herein, e.g., its promoter and/or enhancers, e.g. to form triple helical structures that prevent transcription of the gene in target cells. See generally, Helene, C. (1991) Anticancer Drug Des. 6(6): 569-84; Helene, C. et al. (1992) Ann. N.Y. Acad. Sci. 660:27-36; and Maher, L. J. (1992) Bioassays 14(12):807-15.

Furthermore the present invention relates to a double stranded RNA molecule capable for the reduction or inhibition of the activity of the gene product of a gene encoding the polypeptide of the invention, a polypeptide used in the process of the invention, the nucleic acid molecule of the invention or a nucleic acid molecule used in the process of the invention encoding.

The method of regulating genes by means of double-stranded RNA ("double-stranded RNA interference"; dsRNAi) has been described extensively for animal, yeast, fungi and plant organisms such as Neurospora, zebrafish, Drosophila, mice, planaria, humans, Trypanosoma, petunia or Arabidopsis (for example Matzke M A et al. (2000) Plant Mol. Biol. 43: 401-415; Fire A. et al. (1998) Nature 391: 806-811; WO 99/32619; WO 99/53050; WO 00/68374; WO 00/44914; WO 00/44895; WO 00/49035; WO 00/63364). In addition RNAi is also documented as an advantageously tool for the repression of genes in bacteria such as E. coli for example by Tchurikov et al. [J. Biol. Chem., 2000, 275 (34): 26523-26529]. Fire et al. named the phenomenon RNAi for "RNA interference". The techniques and methods described in the above references are expressly referred to. Efficient gene suppression can also be observed in the case of transient expression or following transient transformation, for example as the consequence of a biolistic transformation (Schweizer P et al. (2000) Plant J 2000 24: 895-903). dsRNAi methods are based on the phenomenon that the simultaneous introduction of complementary strand and counterstrand of a gene transcript brings about highly effective suppression of the expression of the gene in question. The resulting phenotype is very similar to that of an analogous knock-out mutant (Waterhouse P M et al. (1998) Proc. Natl. Acad. Sci. USA 95: 13959-64).

Tuschl et al. [Gens Dev., 1999, 13 (24): 3191-3197] was able to show that the efficiency of the RNAi method is a function of the length of the duplex, the length of the 3'-end overhangs, and the sequence in these overhangs. Based on the work of Tuschl et al. the following guidelines can be given to the skilled worker: To achieve good results the 5' and 3' untranslated regions of the used nucleic acid sequence and regions close to the start codon should be avoided as this regions are richer in regulatory protein binding sites and interactions between RNAi sequences and such regulatory proteins might lead to undesired interactions. Preferably a region of the used mRNA is selected, which is 50 to 100 nt (=nucleotides or bases) downstream of the AUG start codon. Only dsRNA (=double-stranded RNA) sequences from exons are useful for the method, as sequences from introns have no effect. The G/C content in this region should be greater than 30% and less than 70% ideally around 50%. A possible secondary structure of the target mRNA is less important for the effect of the RNAi method.

The dsRNAi method has proved to be particularly effective and advantageous for reducing the expression of the nucleic acid sequences of the SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 and/or homologs thereof. As described inter alia in WO 99/32619, dsRNAi approaches are clearly superior to traditional antisense approaches. The invention therefore furthermore relates to double-stranded RNA molecules (dsRNA molecules) which, when introduced into an organism, advantageously into a plant (or a cell, tissue, organ or seed derived therefrom), bring about altered metabolic activity by the reduction in the expression of the nucleic acid sequences of the SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 and/or homologs thereof. In a double-stranded RNA molecule for reducing the expression of an protein encoded by a nucleic acid sequence of one of the SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 and/or homologs thereof, one of the two RNA strands is essentially identical to at least part of a nucleic acid sequence, and the respective other RNA strand is essentially identical to at least part of the complementary strand of a nucleic acid sequence.

The term "essentially identical" refers to the fact that the dsRNA sequence may also include insertions, deletions and individual point mutations in comparison to the target sequence while still bringing about an effective reduction in expression. Preferably, the homology as defined above amounts to at least 30%, preferably at least 40%, 50%, 60%, 70% or 80%, very especially preferably at least 90%, most preferably 100%, between the "sense" strand of an inhibitory dsRNA and a part-segment of a nucleic acid sequence of the invention (or between the "antisense" strand and the complementary strand of a nucleic acid sequence, respectively). The part-segment amounts to at least 10 bases, preferably at least 17, 18, 19, 20, 21, 22, 23, 24, 25, 26, 27, 28, 29 or 30 bases, especially preferably at least 40, 50, 60, 70, 80 or 90 bases, very especially preferably at least 100, 200, 300 or 400 bases, most preferably at least 500, 600, 700, 800, 900 or more bases or at least 1000 or 2000 bases or more in length. In another preferred embodiment of the invention the part-segment amounts to 17, 18, 19, 20, 21, 22, 23, 24, 25, 26 or 27 bases, preferably to 20, 21, 22, 23, 24 or 25 bases. These short sequences are preferred in animals and plants. The longer sequences preferably between 200 and 800 bases are preferred in nonmammalian animals, preferably in invertebrates, in yeast, fungi or bacteria, but they are also useable in plants. Long double-stranded RNAs are processed in the organisms into many siRNAs (=small/short interfering RNAs) for example by the protein Dicer, which is a ds-specific Rnase III enzyme. As an alternative, an "essentially identical" dsRNA may also be defined as a nucleic acid sequence, which is capable of hybridizing with part of a gene transcript (for example in 400 mM NaCl, 40 mM PIPES pH 6.4, 1 mM EDTA at 50° C. or 70° C. for 12 to 16 h).

The dsRNA may consist of one or more strands of polymerized ribonucleotides. Modification of both the sugar-phosphate backbone and of the nucleosides may furthermore be present. For example, the phosphodiester bonds of the natural RNA can be modified in such a way that they encompass at least one nitrogen or sulfur heteroatom. Bases may undergo modification in such a way that the activity of, for example, adenosine deaminase is restricted. These and other modifications are described herein below in the methods for stabilizing antisense RNA.

The dsRNA can be prepared enzymatically; it may also be synthesized chemically, either in full or in part.

The double-stranded structure can be formed starting from a single, self-complementary strand or starting from two complementary strands. In a single, self-complementary strand, "sense" and "antisense" sequence can be linked by a linking sequence ("linker") and form for example a hairpin structure. Preferably, the linking sequence may take the form of an intron, which is spliced out following dsRNA synthesis. The nucleic acid sequence encoding a dsRNA may contain further elements such as, for example, transcription termination signals or polyadenylation signals. If the two strands of the dsRNA are to be combined in a cell or an organism advantageously in a plant, this can be brought about in a variety of ways.

Formation of the RNA duplex can be initiated either outside the cell or within the cell. As shown in WO 99/53050, the dsRNA may also encompass a hairpin structure, by linking the "sense" and "antisense" strands by a "linker" (for example an intron). The self-complementary dsRNA structures are preferred since they merely require the expression of a construct and always encompass the complementary strands in an equimolar ratio.

The expression cassettes encoding the "antisense" or the "sense" strand of the dsRNA or the self-complementary strand of the dsRNA are preferably inserted into a vector and stably inserted into the genome of a plant, using the methods described herein below (for example using selection markers), in order to ensure permanent expression of the dsRNA.

The dsRNA can be introduced using an amount which makes possible at least one copy per cell. A larger amount (for example at least 5, 10, 100, 500 or 1000 copies per cell) may bring about more efficient reduction.

As has already been described, 100% sequence identity between the dsRNA and a gene transcript of a nucleic acid sequence of one of the SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 or it's homolog is not necessarily required in order to bring about effective reduction in the expression. The advantage is, accordingly, that the method is tolerant with regard to sequence deviations as may be present as a consequence of genetic mutations, polymorphisms or evolutionary divergences. Thus, for example, using the dsRNA, which has been generated starting from a sequence of one of SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 or homologs thereof of the one organism, may be used to suppress the corresponding expression in another organism.

Due to the high degree of sequence homology between sequences from various organisms (e.g. plants), allows the conclusion that these proteins may be conserved to a high degree within, for example other, plants, it is optionally possible that the expression of a dsRNA derived from one of the disclosed sequences as shown herein or homologs thereof should also have has an advantageous effect in other plant species. Preferably the consensus sequences shown herein can be used for the construction of useful dsRNA molecules.

The dsRNA can be synthesized either in vivo or in vitro. To this end, a DNA sequence encoding a dsRNA can be introduced into an expression cassette under the control of at least one genetic control element (such as, for example, promoter, enhancer, silencer, splice donor or splice acceptor or polyadenylation signal). Suitable advantageous constructs are described herein below. Polyadenylation is not required, nor do elements for initiating translation have to be present.

A dsRNA can be synthesized chemically or enzymatically. Cellular RNA polymerases or bacteriophage RNA polymerases (such as, for example T3, T7 or SP6 RNA polymerase) can be used for this purpose. Suitable methods for the in-vitro expression of RNA are described (WO 97/32016; U.S. Pat. No. 5,593,874; U.S. Pat. No. 5,698,425, U.S. Pat. No. 5,712,135, U.S. Pat. No. 5,789,214, U.S. Pat. No. 5,804, 693). Prior to introduction into a cell, tissue or organism, a dsRNA which has been synthesized in vitro either chemically or enzymatically can be isolated to a higher or lesser degree from the reaction mixture, for example by extraction, precipitation, electrophoresis, chromatography or combinations of these methods. The dsRNA can be introduced directly into the cell or else be applied extracellularly (for example into the interstitial space).

Advantageously the RNAi method leads to only a partial loss of gene function and therefore enables the skilled worker to study a gene dose effect in the disered organism and to fine tune the process of the invention. Futhermore it enables a person skilled in the art to study multiple functions of a gene.

Stable transformation of the plant with an expression construct, which brings about the expression of the dsRNA is preferred, however. Suitable methods are described herein below.

A further embodiment of the invention also relates to a method for the generation of a transgenic host or host cell, e.g. a eukaryotic or prokaryotic cell, preferably a transgenic microorganism, a transgenic plant cell or a transgenic plant tissue or a transgenic plant, which comprises introducing, into the plant, the plant cell or the plant tissue, the nucleic acid construct according to the invention, the vector according to the invention, or the nucleic acid molecule according to the invention.

A further embodiment of the invention also relates to a method for the transient generation of a host or host cell, eukaryotic or prokaryotic cell, preferably a transgenic microorganism, a transgenic plant cell or a transgenic plant tissue or a transgenic plant, which comprises introducing, into the plant, the plant cell or the plant tissue, the nucleic acid construct according to the invention, the vector according to the invention, the nucleic acid molecule characterized herein as being contained in the nucleic acid construct of the invention or the nucleic acid molecule according to the invention, whereby the introduced nucleic acid molecules, nucleic acid construct and/or vector is not integrated into the genome of the host or host cell. Therefore the transformants are not stable during the propagation of the host in respect of the introduced nucleic acid molecules, nucleic acid construct and/or vector.

In the process according to the invention, transgenic organisms are also to be understood as meaning—if they take the form of plants—plant cells, plant tissues, plant organs such as root, shoot, stem, seed, flower, tuber or leaf, or intact plants which are grown for the production of the fine chemical.

Growing is to be understood as meaning for example culturing the transgenic plant cells, plant tissue or plant organs on or in a nutrient medium or the intact plant on or in a substrate, for example in hydroponic culture, potting compost or on a field soil.

In a further advantageous embodiment of the process, the nucleic acid molecules can be expressed in single-celled plant cells (such as algae), see Falciatore et al., 1999, Marine Biotechnology 1 (3): 239-251 and references cited therein, and plant cells from higher plants (for example spermatophytes such as crops). Examples of plant expression vectors encompass those which are described in detail herein or in: Becker, D. [(1992) Plant Mol. Biol. 20:1195-1197] and Bevan, M. W. [(1984), Nucl. Acids Res. 12:8711-8721; Vectors for Gene Transfer in Higher Plants; in: Transgenic Plants, Vol. 1, Engineering and Utilization, Ed.: Kung and R. Wu, Academic Press, 1993, pp. 15-38]. An overview of binary vectors and their use is also found in Hellens, R. [(2000), Trends in Plant Science, Vol. 5 No. 10, 446-451.

Vector DNA can be introduced into prokaryotic or eukaryotic cells via conventional transformation or transfection techniques. The terms "transformation" and "transfection" include conjugation and transduction and, as used in the present context, are intended to encompass a multiplicity of prior-art methods for introducing foreign nucleic acid molecules (for example DNA) into a host cell, including calcium phosphate coprecipitation or calcium chloride coprecipitation, DEAE-dextran-mediated transfection, PEG-mediated transfection, lipofection, natural competence, chemically mediated transfer, electroporation or particle bombardment. Suitable methods for the transformation or transfection of host cells, including plant cells, can be found in Sambrook et al. (Molecular Cloning: A Laboratory Manual., 2nd Ed., Cold Spring Harbor Laboratory, Cold Spring Harbor Laboratory Press, Cold Spring Harbor, N.Y., 1989) and in other laboratory handbooks such as Methods in Molecular Biology, 1995, Vol. 44, *Agrobacterium* protocols, Ed.: Gartland and Davey, Humana Press, Totowa, N.J.

The above-described methods for the transformation and regeneration of plants from plant tissues or plant cells are exploited for transient or stable transformation of plants. Suitable methods are the transformation of protoplasts by polyethylene-glycol-induced DNA uptake, the biolistic method with the gene gun—known as the particle bombardment method—, electroporation, the incubation of dry embryos in DNA-containing solution, microinjection and the *Agrobacterium*-mediated gene transfer. The abovementioned methods are described for example in B. Jenes, Techniques for Gene Transfer, in: Transgenic Plants, Vol. 1, Engineering and Utilization, edited by S. D. Kung and R. Wu, Academic Press (1993) 128-143 and in Potrykus Annu. Rev. Plant Physiol. Plant Molec. Biol. 42 (1991) 205-225. The construct to be expressed is preferably cloned into a vector, which is suitable for transforming *Agrobacterium tumefaciens*, for example pBin19 (Bevan, Nucl. Acids Res. 12 (1984) 8711). Agrobacteria transformed with such a vector can then be used in the known manner for the transformation of plants, in particular crop plants, such as, for example, tobacco plants, for example by bathing scarified leaves or leaf segments in an agrobacterial solution and subsequently culturing them in suitable media. The transformation of plants with *Agrobacterium tumefaciens* is described for example by Höfgen and Willmitzer in Nucl. Acid Res. (1988) 16, 9877 or known from, inter alia, F. F. White, Vectors for Gene Transfer in Higher Plants; in Transgenic Plants, Vol. 1, Engineering and Utilization, edited by S. D. Kung and R. Wu, Academic Press, 1993, pp. 15-38.

To select for the successful transfer of the nucleic acid molecule, vector or nucleic acid construct of the invention according to the invention into a host organism, it is advantageous to use marker genes as have already been described above in detail. It is known of the stable or transient integration of nucleic acids into plant cells that only a minority of the cells takes up the foreign DNA and, if desired, integrates it into its genome, depending on the expression vector used and the transfection technique used. To identify and select these integrants, a gene encoding for a selectable marker (as described above, for example resistance to antibiotics) is usually introduced into the host cells together with the gene of interest. Preferred selectable markers in plants comprise those, which confer resistance to an herbicide such as glyphosate or gluphosinate. Other suitable markers are, for example, markers, which encode genes involved in biosynthetic pathways of, for example, sugars or amino acids, such as β-galactosidase, ura3 or ilv2. Markers, which encode genes such as luciferase, gfp or other fluorescence genes, are likewise suitable. These markers and the aforementioned markers can be used in mutants in whom these genes are not functional since, for example, they have been deleted by conventional methods. Furthermore, nucleic acid molecules, which encode a selectable marker, can be introduced into a host cell on the same vector as those, which encode the polypeptides of the invention or used in the process or else in a separate vector. Cells which have been transfected stably with the nucleic acid introduced can be identified for example by selection (for example, cells which have integrated the selectable marker survive whereas the other cells die).

Since the marker genes, as a rule specifically the gene for resistance to antibiotics and herbicides, are no longer required or are undesired in the transgenic host cell once the nucleic acids have been introduced successfully, the process according to the invention for introducing the nucleic acids advantageously employs techniques which enable the removal, or excision, of these marker genes. One such a method is what is known as cotransformation. The cotransformation method employs two vectors simultaneously for the transformation, one vector bearing the nucleic acid according to the invention and a second bearing the marker gene(s). A large proportion of transformants receives or, in the case of plants, comprises (up to 40% of the transformants and above), both vectors. In case of transformation with Agrobacteria, the transformants usually receive only a part of the vector, the sequence flanked by the T-DNA which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase resource or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases, the marker gene must be eliminated by performing crosses. In microbiology, techniques were developed which make possible, or facilitate, the detection of such events. A further advantageous method relies on what are known as recombination systems, whose advantage is that elimination by crossing can be dispensed with. The best-known system of this type is what is known as the Cre/lox system. Cre1 is a recombinase, which removes the sequences located between the loxP sequences. If the marker gene is integrated between the loxP sequences, it is removed, once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Agrobacteria transformed with an expression vector according to the invention may also be used in the manner known per se for the transformation of plants such as experimental plants like *Arabidopsis* or crop plants, such as, for example, cereals, maize, oats, rye, barley, wheat, soya, rice, cotton, sugarbeet, canola, sunflower, flax, hemp, potato, tobacco, tomato, carrot, bell peppers, oilseed rape, tapioca, cassava, arrow root, tagetes, alfalfa, lettuce and the various tree, nut, and grapevine species, in particular oil-containing crop plants such as soya, peanut, castor-oil plant, sunflower, maize, cotton, flax, oilseed rape, coconut, oil palm, safflower (*Carthamus tinctorius*) or cocoa beans, for example by bathing scarified leaves or leaf segments in an agrobacterial solution and subsequently growing them in suitable media.

In addition to the transformation of somatic cells, which then has to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with agrobacteria and seeds are obtained from the developing plants of which a certain proportion is transformed and thus transgenic (Feldman, K A and Marks M D (1987). Mol Gen Genet 208:274-289; Feldmann K (1992). In: C Koncz, N-H Chua and J. Shell, eds, Methods in *Arabidopsis* Research. Word Scientific, Singapore, pp. 274-289). Alternative methods are based on the repeated removal of the influorescences and incubation of the excision site in the center of the rosette with transformed agrobacteria, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension (Bechthold, N (1993). C R Acad Sci Paris Life Sci, 316: 1194-1199), while in the case of the "floral dip" method the developing floral tissue is incubated briefly with a surfactant-treated agrobacterial suspension (Clough, S J und Bent, A F (1998). The Plant J. 16, 735-743). A certain proportion of transgenic seeds are harvested in both cases, and these seeds can be distinguished from nontransgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process, which has been schematically displayed in Klaus et al., 2004 (Nature Biotechnology 22(2), 225-229). Briefly the sequences to be transformed are cloned together with a selectable marker gene between flanking sequences homologous to the chloroplast genome. These homologous flanking sequences direct site-specific integration into the plastome. Plastidal transformation has been described for many different plant species and an overview can be taken from Bock (2001) Transgenic plastids in basic research and plant biotechnology. J Mol Biol. 2001 Sep. 21; 312(3): 425-38 or Maliga, P (2003) Progress towards commercialization of plastid transformation technology. Trends Biotechnol. 21, 20-28. Further biotechnological progress has recently been reported in form of marker free plastid transformants, which can be produced by a transient cointegrated maker gene (Klaus et al., 2004, Nature Biotechnology 22(2), 225-229).

The genetically modified plant cells can be regenerated via all methods with which the skilled worker is familiar. Suitable methods can be found in the abovementioned publications of S. D. Kung and R. Wu, Potrykus or Höfgen and Willmitzer.

Accordingly, the present invention thus also relates to a plant cell comprising the nucleic acid construct according to the invention, the nucleic acid molecule according to the invention or the vector according to the invention.

Accordingly the present invention relates to any cell transgenic for any nucleic acid characterized as part of the invention, e.g. conferring the increase of the fine chemical in a cell or an organism or a part thereof, e.g. the nucleic acid molecule of the invention, the nucleic acid construct of the invention, the antisense molecule of the invention, the vector of the invention or a nucleic acid molecule encoding the polypeptide of the invention, e.g. encoding a polypeptide having the biological activity of the protein of the invention. Due to the above mentioned activity the fine chemical content in a cell or an organism is increased. For example, due to modulation or manipulation, the cellular activity is increased, e.g. due to an increased expression or specific activity of the subject matters of the invention in a cell or an organism or a part thereof. Transgenic for a polypeptide having biological activity of the protein of the invention or activity means herein that due to modulation or manipulation of the genome, the biological activity of the protein of the invention is increased in the cell or organism or part thereof. Examples are described above in context with the process of the invention "Transgenic", for example regarding a nucleic acid molecule, an nucleic acid construct or a vector comprising said nucleic acid molecule or an organism transformed with said nucleic acid molecule, nucleic acid construct or vector, refers to all those subjects originating by recombinant methods in which either a) the nucleic acid sequence, or
b) a genetic control sequence linked operably to the nucleic acid sequence, for example a promoter, or
c) (a) and (b)

are not located in their natural genetic environment or have been modified by recombinant methods, an example of a modification being a substitution, addition, deletion, inversion or insertion of one or more nucleotide residues. Natural genetic environment refers to the natural chromosomal locus in the organism of origin, or to the presence in a genomic library. In the case of a genomic library, the natural genetic environment of the nucleic acid sequence is preferably retained, at least in part. The environment flanks the nucleic acid sequence at least at one side and has a sequence of at least 50 bp, preferably at least 500 bp, especially preferably at least 1000 bp, very especially preferably at least 5000 bp, in length.

A naturally occurring expression cassette—for example the naturally occurring combination of the promoter of the protein of the invention with the corresponding protein gene—becomes a transgenic expression cassette when it is modified by non-natural, synthetic "artificial" methods such as, for example, mutagenization. Such methods have been described (U.S. Pat. No. 5,565,350; WO 00/15815; also see above).

Further, the plant cell, plant tissue or plant can also be transformed such that further enzymes and proteins are (over) expressed which expression supports an increase of the fine chemical.

However, transgenic also means that the nucleic acids according to the invention are located at their natural position in the genome of an organism, but that the sequence has been modified in comparison with the natural sequence and/or that the regulatory sequences of the natural sequences have been modified. Preferably, transgenic/recombinant is to be understood as meaning the transcription of the nucleic acids used in the process according to the invention occurs at a non-natural position in the genome, that is to say the expression of the nucleic acids is homologous or, preferably, heterologous. This expression can be transiently or of a sequence integrated stably into the genome.

The term "transgenic plants" used in accordance with the invention also refers to the progeny of a transgenic plant, for example the $T_1$, $T_2$, $T_3$ and subsequent plant generations or the $BC_1$, $BC_2$, $BC_3$ and subsequent plant generations. Thus, the transgenic plants according to the invention can be raised and selfed or crossed with other individuals in order to obtain further transgenic plants according to the invention. Transgenic plants may also be obtained by propagating transgenic plant cells vegetatively. The present invention also relates to transgenic plant material, which can be derived from a transgenic plant population according to the invention. Such material includes plant cells and certain tissues, organs and parts of plants in all their manifestations, such as seeds, leaves, anthers, fibers, tubers, roots, root hairs, stems, embryo, calli, cotelydons, petioles, harvested material, plant tissue, reproductive tissue and cell cultures, which are derived from the actual transgenic plant and/or can be used for bringing about the transgenic plant.

Any transformed plant obtained according to the invention can be used in a conventional breeding scheme or in in vitro plant propagation to produce more transformed plants with the same characteristics and/or can be used to introduce the same characteristic in other varieties of the same or related species. Such plants are also part of the invention. Seeds obtained from the transformed plants genetically also contain the same characteristic and are part of the invention. As mentioned before, the present invention is in principle applicable to any plant and crop that can be transformed with any of the transformation method known to those skilled in the art. Another embodiment of the invention is the use of the nucleic acid molecule as claimed in above in mapping and breeding processes for the identification of plant varieties having and increased capacity for production of the fine chemical.

In an especially preferred embodiment, the organism, the host cell, plant cell, plant, microorganism or plant tissue according to the invention is transgenic.

Accordingly, the invention therefore relates to transgenic organisms transformed with at least one nucleic acid molecule, nucleic acid construct or vector according to the invention, and to cells, cell cultures, tissues, parts—such as, for example, in the case of plant organisms, plant tissue, for example leaves, roots and the like—or propagation material derived from such organisms, or intact plants. The terms "recombinant (host)", and "transgenic (host)" are used interchangeably in this context. Naturally, these terms refer not only to the host organism or target cell in question, but also to the progeny, or potential progeny, of these organisms or cells. Since certain modifications may occur in subsequent generations owing to mutation or environmental effects, such progeny is not necessarily identical with the parental cell, but still comes within the scope of the term as used herein.

Suitable organisms for the process according to the invention or as hosts are all these eukaryotic or prokaryotic organisms, which are capable of synthesizing the fine chemical. The organisms used as hosts are microorganisms, such as bacteria, fungi, yeasts or algae, non-human animals, or plants, such as dictotyledonous or monocotyledonous plants.

In principle all plants can be used as host organism, especially the plants mentioned above as source organism. Preferred transgenic plants are, for example, selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants such as plants advantageously selected from the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassava, potato, sugarbeet, egg plant, alfalfa, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, dwarf bean, lupin, clover and Lucerne for mentioning only some of them.

Preferred plant cells, plant organs, plant tissues or parts of plants originate from the under source organism mentioned plant families, preferably from the abovementioned plant genus, more preferred from abovementioned plants spezies.

Transgenic plants comprising the fine chemical synthesized in the process according to the invention can be marketed directly without isolation of the compounds synthesized. In the process according to the invention, plants are understood as meaning all plant parts, plant organs such as leaf, stalk, root, tubers or seeds or propagation material or harvested material or the intact plant. In this context, the seed encompasses all parts of the seed such as the seed coats, epidermal cells, seed cells, endosperm or embryonic tissue. The fine chemical produced in the process according to the invention may, however, also be isolated from the plant in free or bound form. The fine chemical produced by this process can be harvested by harvesting the organisms either from the culture in which they grow or from the field. This can be done via expressing, grinding and/or extraction, salt precipitation and/or ion-exchange chromatography of the plant parts, preferably the plant seeds, plant fruits, plant tubers and the like.

In a further embodiment, the present invention relates to a process for the generation of a microorganism, comprising the introduction, into the microorganism or parts thereof, of the nucleic acid construct of the invention, or the vector of the invention or the nucleic acid molecule of the invention.

In another embodiment, the present invention relates also to a transgenic microorganism comprising the nucleic acid molecule of the invention, the nucleic acid construct of the invention or the vector as of the invention. Appropriate microorganisms have been described herein before under source organism, preferred are in particular aforementioned strains suitable for the production of fine chemicals.

Accordingly, the present invention relates also to a process according to the present invention whereby the produced fine chemical or fine chemical composition is isolated.

In this manner, more than 50% by weight, advantageously more than 60% by weight, preferably more than 70% by weight, especially preferably more than 80% by weight, very especially preferably more than 90% by weight, of the fine chemical produced in the process can be isolated. The resulting fine chemical can, if appropriate, subsequently be further purified, if desired mixed with other active ingredients such as vitamins, amino acids, carbohydrates, antibiotics and the like, and, if appropriate, formulated.

The fine chemical obtained in the process is suitable as starting material for the synthesis of further products of value. For example, they can be used in combination with other ingredients or alone for the production of pharmaceuticals, foodstuffs, animal feeds or cosmetics. Accordingly, the present invention relates a method for the production of a pharmaceuticals, food stuff, animal feeds, nutrients or cosmetics comprising the steps of the process according to the invention, including the isolation of the fine chemical or fine chemical composition produced and if desired formulating the product with a pharmaceutical acceptable carrier or formulating the product in a form acceptable for an application in agriculture. A further embodiment according to the invention is the use of the fine chemical produced in the process or of the transgenic organisms in animal feeds, foodstuffs, medicines, food supplements, cosmetics or pharmaceuticals.

In principle all microorganisms can be used as host organism especially the ones mentioned under source organism above. It is advantageous to use in the process of the invention transgenic microorganisms such as fungi such as the genus *Claviceps* or *Aspergillus* or Gram-positive bacteria such as the genera *Bacillus, Corynebacterium, Micrococcus, Brevibacterium, Rhodococcus, Nocardia, Caseobacter* or *Arthrobacter* or Gram-negative bacteria such as the genera *Escherichia, Flavobacterium* or *Salmonella* or yeasts such as the genera *Rhodotorula, Saccharomyces, Hansenula* or *Candida*. Particularly advantageous organisms are selected from the group of genera *Corynebacterium, Brevibacterium, Escherichia, Bacillus, Rhodotorula, Saccharomyces, Hansenula, Candida, Claviceps* or *Flavobacterium*. It is very particularly advantageous to use in the process of the invention microorganisms selected from the group of genera and species consisting of *Saccharomyces cerevisiae, Hansenula anomala, Candida utilis, Claviceps purpurea, Bacillus circulans, Bacillus subtilis, Bacillus* sp., *Brevibacterium albidum, Brevibacterium album, Brevibacterium cerinum, Brevibacterium flavum, Brevibacterium glutamigenes, Brevibacterium iodinum, Brevibacterium ketoglutamicum, Brevibacterium lactofermentum, Brevibacterium linens, Brevibacterium roseum, Brevibacterium saccharolyticum, Brevibacterium* sp., *Corynebacterium acetoacidophilum, Corynebacterium*

*acetoglutamicum, Corynebacterium ammoniagenes, Corynebacterium glutamicum (=Micrococcus glutamicum), Corynebacterium melassecola, Corynebacterium* sp. or *Escherichia coli*, specifically *Saccharomyces cerevisiae, Escherichia coli* K12 and its described strains.

The process of the invention is, when the host organisms are microorganisms, advantageously carried out at a temperature between 0° C. and 95° C., preferably between 10° C. and 85° C., particularly preferably between 15° C. and 75° C., very particularly preferably between 15° C. and 45° C. The pH is advantageously kept at between pH 4 and 12, preferably between pH 6 and 9, particularly preferably between pH 7 and 8, during this. The process of the invention can be operated batchwise, semibatchwise or continuously. A summary of known cultivation methods is to be found in the textbook by Chmiel (Bioprozeβtechnik 1. Einführung in die Bioverfahrenstechnik (Gustav Fischer Verlag, Stuttgart, 1991)) or in the textbook by Storhas (Bioreaktoren und periphere Einrichtungen (Vieweg Verlag, Braunschweig/Wiesbaden, 1994)). The culture medium to be used must meet the requirements of the respective strains in a suitable manner. Descriptions of culture media for various microorganisms are present in the handbook "Manual of Methods for General Bacteriology" of the American Society for Bacteriology (Washington D.C., USA, 1981). These media, which can be employed according to the invention include, as described above, usually one or more carbon sources, nitrogen sources, inorganic salts, vitamins and/or trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch or cellulose. Sugars can also be added to the media via complex compounds such as molasses, or other byproducts of sugar refining. It may also be advantageous to add mixtures of various carbon sources. Other possible carbon sources are oils and fats such as, for example, soybean oil, sunflower oil, peanut oil and/or coconut fat, fatty acids such as, for example, palmitic acid, stearic acid and/or linoleic acid, alcohols and/or polyalcohols such as, for example, glycerol, methanol and/or ethanol and/or organic acids such as, for example, acetic acid and/or lactic acid. Nitrogen sources are usually organic or inorganic nitrogen compounds or materials, which contain these compounds. Examples of nitrogen sources include ammonia in liquid or gaseous form or ammonium salts such as ammonium sulfate, ammonium chloride, ammonium phosphate, ammonium carbonate or ammonium nitrate, nitrates, urea, amino acids or complex nitrogen sources such as corn steep liquor, soybean meal, soybean protein, yeast extract, meat extract and others. The nitrogen sources may be used singly or as a mixture. Inorganic salt compounds, which may be present in the media include the chloride, phosphorus or sulfate salts of calcium, magnesium, sodium, cobalt, molybdenum, potassium, manganese, zinc, copper and iron.

For preparing sulfur-containing fine chemicals, in particular the fine chemical, it is possible to use as sulfur source inorganic sulfur-containing compounds such as, for example, sulfates, sulfites, dithionites, tetrathionates, thiosulfates, sulfides or else organic sulfur compounds such as mercaptans and thiols.

It is possible to use as phosphorus source phosphoric acid, potassium dihydrogenphosphate or dipotassium hydrogenphosphate or the corresponding sodium-containing salts. Chelating agents can be added to the medium in order to keep the metal ions in solution. Particularly suitable chelating agents include dihydroxyphenols such as catechol or protocatechuate, or organic acids such as citric acid. The fermentation media employed according to the invention for cultivating microorganisms normally also contain other growth factors such as vitamins or growth promoters, which include, for example, biotin, riboflavin, thiamine, folic acid, nicotinic acid, pantothenate and pyridoxine. Growth factors and salts are often derived from complex media components such as yeast extract, molasses, corn steep liquor and the like. Suitable precursors can moreover be added to the culture medium. The exact composition of the media compounds depends greatly on the particular experiment and is chosen individually for each specific case. Information about media optimization is obtainable from the textbook "Applied Microbiol. Physiology, A Practical Approach" (editors P. M. Rhodes, P. F. Stanbury, IRL Press (1997) pp. 53-73, ISBN 0 19 963577 3). Growth media can also be purchased from commercial suppliers such as Standard 1 (Merck) or BHI (Brain heart infusion, DIFCO) and the like. All media components are sterilized either by heat (1.5 bar and 121° C. for 20 min) or by sterilizing filtration. The components can be sterilized either together or, if necessary, separately. All media components can be present at the start of the cultivation or optionally be added continuously or batchwise. The temperature of the culture is normally between 15° C. and 45° C., preferably at 25° C. to 40° C., and can be kept constant or changed during the experiment. The pH of the medium should be in the range from 5 to 8.5, preferably around 7. The pH for the cultivation can be controlled during the cultivation by adding basic compounds such as sodium hydroxide, potassium hydroxide, ammonia or aqueous ammonia or acidic compounds such as phosphoric acid or sulfuric acid. Foaming can be controlled by employing antifoams such as, for example fatty acid polyglycol esters. The stability of plasmids can be maintained by adding to the medium suitable substances having a selective effect, for example antibiotics. Aerobic conditions are maintained by introducing oxygen or oxygen-containing gas mixtures such as, for example ambient air into the culture. The temperature of the culture is normally from 20° C. to 45° C. and preferably from 25° C. to 40° C. The culture is continued until formation of the desired product is at a maximum. This aim is normally achieved within 10 hours to 160 hours.

The fermentation broths obtained in this way, containing the fine chemical in particular for example amino acids such as L-methionine, L-threonine and/or L-lysine, normally have a dry matter content of from 7.5 to 25% by weight. Sugar-limited fermentation is additionally advantageous, at least at the end, but especially over at least 30% of the fermentation time. This means that the concentration of utilizable sugar in the fermentation medium is kept at, or reduced to, $\geqq 0$ to 3 g/l during this time. The fermentation broth is then processed further. Depending on requirements, the biomass can be removed entirely or partly by separation methods, such as, for example, centrifugation, filtration, decantation or a combination of these methods, from the fermentation broth or left completely in it. The fermentation broth can then be thickened or concentrated by known methods, such as, for example, with the aid of a rotary evaporator, thin-film evaporator, falling film evaporator, by reverse osmosis or by nanofiltration. This concentrated fermentation broth can then be worked up by freeze-drying, spray drying, spray granulation or by other processes.

However, it is also possible to purify the fine chemical produced further. For this purpose, the product-containing composition is subjected to a chromatography on a suitable resin, in which case the desired product or the impurities are retained wholly or partly on the chromatography resin. These chromatography steps can be repeated if necessary, using the same or different chromatography resins. The skilled worker is familiar with the choice of suitable chromatography resins and their most effective use. The purified product can be concentrated by filtration or ultrafiltration and stored at a temperature at which the stability of the product is a maximum.

The identity and purity of the isolated compound(s) can be determined by prior art techniques. These include high performance liquid chromatography (HPLC), spectroscopic methods, mass spectrometry (MS), staining methods, thin-layer chromatography, NIRS, enzyme assay or microbiological assays. These analytical methods are summarized in: Patek et al. (1994) Appl. Environ. Microbiol. 60:133-140; Malakhova et al. (1996) Biotekhnologiya 11 27-32; and Schmidt et al. (1998) Bioprocess Engineer. 19:67-70. Ulmann's Encyclopedia of Industrial Chemistry (1996) Vol. A27, VCH: Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Vol. 17.

In yet another aspect, the invention also relates to harvestable parts and to propagation material of the transgenic plants according to the invention which either contain transgenic plant cells expressing a nucleic acid molecule according to the invention or which contains cells which show an increased cellular activity of the polypeptide of the invention, e.g. an increased expression level or higher activity of the described protein.

Harvestable parts can be in principle any useful parts of a plant, for example, flowers, pollen, seedlings, tubers, leaves, stems, fruit, seeds, roots etc. Propagation material includes, for example, seeds, fruits, cuttings, seedlings, tubers, rootstocks etc. Preferred are seeds, fruits, seedlings or tubers as harvestable or propagation material.

The invention furthermore relates to the use of the transgenic organisms according to the invention and of the cells, cell cultures, parts—such as, for example, roots, leaves and the like as mentioned above in the case of transgenic plant organisms—derived from them, and to transgenic propagation material such as seeds or fruits and the like as mentioned above, for the production of foodstuffs or feeding stuffs, pharmaceuticals or fine chemicals.

Accordingly in another embodiment, the present invention relates to the use of the nucleic acid molecule, the organism, e.g. the microorganism, the plant, plant cell or plant tissue, the vector, or the polypeptide of the present invention for making fine chemicals such as fatty acids, carotenoids, isoprenoids, vitamins, lipids, wax esters, (poly)saccharides and/or polyhydroxyalkanoates, and/or its metabolism products, in particular, steroid hormones, cholesterol, prostaglandin, triacylglycerols, bile acids and/or ketone bodies producing cells, tissues and/or plants. There are a number of mechanisms by which the yield, production, and/or efficiency of production of fatty acids, carotenoids, isoprenoids, vitamins, wax esters, lipids, (poly)saccharides and/or polyhydroxyalkanoates, and/or its metabolism products, in particular, steroid hormones, cholesterol, triacylglycerols, prostaglandin, bile acids and/or ketone bodies or further of above defined fine chemicals incorporating such an altered protein can be affected. In the case of plants, by e.g. increasing the expression of acetyl-CoA which is the basis for many products, e.g., fatty acids, carotenoids, isoprenoids, vitamines, lipids, (poly)saccharides, wax esters, and/or polyhydroxyalkanoates, and/or its metabolism products, in particular, prostaglandin, steroid hormones, cholesterol, triacylglycerols, bile acids and/or ketone bodies in a cell, it may be possible to increase the amount of the produced said compounds thus permitting greater ease of harvesting and purification or in case of plants more efficient partitioning. Further, one or more of said metabolism products, increased amounts of the cofactors, precursor molecules, and intermediate compounds for the appropriate biosynthetic pathways maybe required. Therefore, by increasing the number and/or activity of transporter proteins involved in the import of nutrients, such as carbon sources (i.e., sugars), nitrogen sources (i.e., amino acids, ammonium salts), phosphate, and sulfur, it may be possible to improve the production of acetyl CoA and its metabolism products as mentioned above, due to the removal of any nutrient supply limitations on the biosynthetic process. In particular, it may be possible to increase the yield, production, and/or efficiency of production of said compounds, e.g. fatty acids, carotenoids, isoprenoids, vitamins, was esters, lipids, (poly)saccharides, and/or polyhydroxyalkanoates, and/or its metabolism products, in particular, steroid hormones, cholesterol, prostaglandin, triacylglycerols, bile acids and/or ketone bodies molecules etc. in plants.

Furthermore preferred is a method for the recombinant production of pharmaceuticals or fine chemicals in host organisms, wherein a host organism is transformed with one of the above-described nucleic acid constructs comprising one or more structural genes which encode the desired fine chemical or catalyze the biosynthesis of the desired fine chemical, the transformed host organism is cultured, and the desired fine chemical is isolated from the culture medium. This method can be applied widely to fine chemicals such as enzymes, vitamins, amino acids, sugars, fatty acids, and natural and synthetic flavorings, aroma substances and colorants or compositions comprising these. Especially preferred is the additional production of further amino acids, tocopherols and tocotrienols and carotenoids or compositions comprising said compounds. The transformed host organisms are cultured and the products are recovered from the host organisms or the culture medium by methods known to the skilled worker or the organism itself servers as food or feed supplement. The production of pharmaceuticals such as, for example, antibodies or vaccines, is described by Hood E E, Jilka J M. Curr Opin Biotechnol. 1999 Aug.; 10(4): 382-6; Ma J K, Vine N D. Curr Top Microbiol Immunol. 1999; 236:275-92.

In one embodiment, the present invention relates to a method for the identification of a gene product conferring an increase in the fine chemical production in a cell, comprising the following steps:

(a) contacting, e.g. hybridising, the nucleic acid molecules of a sample, e.g. cells, tissues, plants or microorganisms or a nucleic acid library, which can contain a candidate gene encoding a gene product conferring an increase in the fine chemical after expression, with the nucleic acid molecule of the present invention;

(b) identifying the nucleic acid molecules, which hybridize under relaxed stringent conditions with the nucleic acid molecule of the present invention in particular to the nucleic acid molecule sequence shown in SEQ ID NO: 1, 3, 5, 7, 9, 11, 13, 15, 17, 19, 21, 23, 25, 27, 29, 31, 33, 35, 37, 39, 41, 43, 45, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391 or 393 and, optionally, isolating the full length cDNA clone or complete genomic clone;

(c) introducing the candidate nucleic acid molecules in host cells, preferably in a plant cell or a microorganism, appropriate for producing the fine chemical;

(d) expressing the identified nucleic acid molecules in the host cells;

(e) assaying the the fine chemical level in the host cells; and (f) identifying the nucleic acid molecule and its gene product which expression confers an increase in the the fine chemical level in the host cell after expression compared to the wild type.

Relaxed hybridisation conditions are: After standard hybridisation procedures washing steps can be performed at low to medium stringency conditions usually with washing conditions of 40°-55° C. and salt conditions between 2×SSC and 0.2×SSC with 0.1% SDS in comparison to stringent washing conditions as e.g. 60°-68° C. with 0.1% SDS. Further examples can be found in the references listed above for the stringend hybridization conditions. Usually washing steps are repeated with increasing stringency and length until a useful signal to noise ratio is detected and depend on many factors as the target, e.g. its purity, GC-content, size etc, the probe, e.g. its length, is it a RNA or a DNA probe, salt conditions, washing or hybridisation temperature, washing or hybridisation time etc.

In another embodiment, the present invention relates to a method for the identification of a gene product conferring an increase in the fine chemical production in a cell, comprising the following steps:

(a) identifiying nucleic acid molecules of an organism; which can contain a candidate gene encoding a gene product conferring an increase in the fine chemical after expression, which are at least 20%, preferably 25%, more preferably 30%, even more preferred are 35%, 40% or 50%, even more preferred are 60%, 70% or 80%, most preferred are 90% or 95% or more homology to the nucleic acid molecule of the present invention, for example via homology search in a data bank;

(b) introducing the candidate nucleic acid molecules in host cells, preferably in a plant cells or microorganisms, appropriate for producing the fine chemical;

(c) expressing the identified nucleic acid molecules in the host cells;

(d) assaying the the fine chemical level in the host cells; and (e) identifying the nucleic acid molecule and its gene product which expression confers an increase in the the fine chemical level in the host cell after expression compared to the wild type.

The nucleic acid molecules identified can then be used for the production of the fine chemical in the same way as the nucleic acid molecule of the present invention. Accordingly, in one embodiment, the present invention relates to a process for the production of the fine chemical, comprising (a) identifying a nucleic acid molecule according to aforementioned steps (a) to (f) or (a) to (e) and recovering the free or bound fine chemical from a organism having an increased cellular activity of a polypeptide encoded by the isolated nucleic acid molecule compared to a wild type.

Furthermore, in one embodiment, the present invention relates to a method for the identification of a compound stimulating production of the fine chemical to said plant comprising:

a) contacting cells which express the polypeptide of the present invention or its mRNA with a candidate compound under cell cultivation conditions;

b) assaying an increase in expression of said polypeptide or said mRNA;

c) comparing the expression level to a standard response made in the absence of said candidate compound; whereby, an increased expression over the standard indicates that the compound is stimulating production of the fine chemical.

Furthermore, in one embodiment, the present invention relates to a method for the screening for agonists or an antagonist of the activity of the polypeptide of the present invention or used in the process of the present invention, e.g. a polypeptide conferring an increase of the fine chemical in an organism or a part therof after increasing the activity in an organism or a part thereof, comprising:

(a) contacting cells, tissues, plants or microorganisms which express the polypeptide according to the invention with a candidate compound or a sample comprising a plurality of compounds under conditions which permit the expression the polypeptide of the present invention or used in the process of the present invention;

(b) assaying the fine chemical level or the polypeptide expression level in the cell, tissue, plant or microorganism or the media the cell, tissue, plant or microorganisms is cultured or maintained in; and (c) identifying a agonist or antagonist by comparing the measured the fine chemical level or polypeptide of the invention or used in the invention expression level with a standard the fine chemical or polypeptide expression level measured in the absence of said candidate compound or a sample comprising said plurality of compounds, whereby an increased level over the standard indicates that the compound or the sample comprising said plurality of compounds is an agonist and a decreased level over the standard indicates that the compound or the sample comprising said plurality of compounds is an antagonist.

Furthermore, in one embodiment, the present invention relates to process for the identification of a compound conferring increased the fine chemical production in a plant or microorganism, comprising the steps:

(a) culturing a cell or tissue or microorganism or maintaining a plant expressing the polypeptide according to the invention or a nucleic acid molecule encoding said polypeptide and a readout system capable of interacting with the polypeptide under suitable conditions which permit the interaction of the polypeptide with said readout system in the presence of a compound or a sample comprising a plurality of compounds and capable of providing a detectable signal in response to the binding of a compound to said polypeptide under conditions which permit the expression of said readout system and the polypeptide of the present invention or used in the process of the invention; and (b) identifying if the compound is an effective agonist by detecting the presence or absence or increase of a signal produced by said readout system.

The screen for a gene product or an agonist conferring an increase in the fine chemical production can be performed by growth of an organism for example a microorganism in the presence of growth reducing amounts of an inhibitor of the synthesis of the fine chemical. Better growth, eg higher dividing rate or high dry mass in comparison to the control under such conditions would identify a gene or gene product or an agonist conferring an increase in fine chemical production.

One can think to screen for increased fine chemical production by for example resistance to a drug blocking the fine chemical synthesis and looking whether this effect is dependent on the protein of the invention e.g. comparing near identical organisms with low and high biological acitivity of the protein of the invention.

Said compound may be chemically synthesized or microbiologically produced and/or comprised in, for example, samples, e.g., cell extracts from, e.g., plants, animals or microorganisms, e.g. pathogens. Furthermore, said compound(s) may be known in the art but hitherto not known to be capable of suppressing or activating the polypeptide of the present invention. The reaction mixture may be a cell free extract or may comprise a cell or tissue culture. Suitable set ups for the method of the invention are known to the person skilled in the art and are, for example, generally described in Alberts et al., Molecular Biology of the Cell, third edition (1994), in particular Chapter 17. The compounds may be, e.g., added to the reaction mixture, culture medium, injected into the cell or sprayed onto the plant.

If a sample containing a compound is identified in the method of the invention, then it is either possible to isolate the compound from the original sample identified as containing the compound capable of activating or increasing the content of the fine chemical in an organism or part thereof, or one can further subdivide the original sample, for example, if it consists of a plurality of different compounds, so as to reduce the number of different substances per sample and repeat the method with the subdivisions of the original sample. Depending on the complexity of the samples, the steps described above can be performed several times, preferably until the sample identified according to the method of the invention only comprises a limited number of or only one substance(s). Preferably said sample comprises substances of similar chemical and/or physical properties, and most preferably said substances are identical. Preferably, the compound identified according to the above-described method or its derivative is further formulated in a form suitable for the application in plant breeding or plant cell and tissue culture.

The compounds which can be tested and identified according to a method of the invention may be expression libraries, e.g., cDNA expression libraries, peptides, proteins, nucleic acids, antibodies, small organic compounds, hormones, peptidomimetics, PNAs or the like (Milner, Nature Medicine 1 (1995), 879-880; Hupp, Cell 83 (1995), 237-245; Gibbs, Cell 79 (1994), 193-198 and references cited supra). Said compounds can also be functional derivatives or analogues of known inhibitors or activators. Methods for the preparation of chemical derivatives and analogues are well known to those skilled in the art and are described in, for example, Beilstein, Handbook of Organic Chemistry, Springer edition New York Inc., 175 Fifth Avenue, New York, N.Y. 10010 U.S.A. and Organic Synthesis, Wiley, New York, USA. Furthermore, said derivatives and analogues can be tested for their effects according to methods known in the art. Furthermore, peptidomimetics and/or computer aided design of appropriate derivatives and analogues can be used, for example, according to the methods described above. The cell or tissue that may be employed in the method of the invention preferably is a host cell, plant cell or plant tissue of the invention described in the embodiments hereinbefore.

Thus, in a further embodiment the invention relates to a compound obtained or identified according to the method for identifiying an agonist of the invention said compound being an agonist of the polypeptide of the present invention or used in the process of the present invention.

Accordingly, in one embodiment, the present invention further relates to a compound identified by the method for identifying a compound of the present invention.

Said compound is, for example, a homologous of the polypeptide of the present invention. Homologues of the polypeptid of the present invention can be generated by mutagenesis, e.g., discrete point mutation or truncation of the polypeptide of the present invenion. As used herein, the term "homologue" refers to a variant form of the protein, which acts as an agonist of the activity of the polypeptide of the present invention. An agonist of said protein can retain substantially the same, or a subset, of the biological activities of the polypeptide of the present invention. In particular, said agonist confers the increase of the expression level of the polypeptide of the present invention and/or the expression of said agonist in an organisms or part thereof confers the increase of free and/or bound the fine chemical in the organism or part thereof.

In one embodiment, the invention relates to an antibody specifically recognizing the compound or agonist of the present invention.

The invention also relates to a diagnostic composition comprising at least one of the aforementioned nucleic acid molecules, vectors, proteins, antibodies or compounds of the invention and optionally suitable means for detection.

The diagnostic composition of the present invention is suitable for the isolation of mRNA from a cell and contacting the mRNA so obtained with a probe comprising a nucleic acid probe as described above under hybridizing conditions, detecting the presence of mRNA hybridized to the probe, and thereby detecting the expression of the protein in the cell. Further methods of detecting the presence of a protein according to the present invention comprise immunotechniques well known in the art, for example enzyme linked immunosorbent assay. Furthermore, it is possible to use the nucleic acid molecules according to the invention as molecular markers or primer in plant breeding. Suitable means for detection are well known to a person skilled in the art, e.g. buffers and solutions for hydridization assays, e.g. the aforementioned solutions and buffers, further and means for Southern-, Western-, Northern- etc.—blots, as e.g. described in Sambrook et al. are known.

In another embodiment, the present invention relates to a kit comprising the nucleic acid molecule, the vector, the host cell, the polypeptide, the antisense nucleic acid, the antibody, plant cell, the plant or plant tissue, the harvestable part, the propagation material and/or the compound or agonist or antagonists identified according to the method of the invention.

The compounds of the kit of the present invention may be packaged in containers such as vials, optionally with/in buffers and/or solution. If appropriate, one or more of said components might be packaged in one and the same container. Additionally or alternatively, one or more of said components might be adsorbed to a solid support as, e.g. a nitrocellulose filter, a glas plate, a chip, or a nylon membrane or to the well of a micro titerplate. The kit can be used for any of the herein described methods and embodiments, e.g. for the production of the host cells, transgenic plants, pharmaceutical compositions, detection of homologous sequences, identification of antagonists or agonists, as food or feed or as a supplement thereof, as supplement for the treating of plants, etc.

Further, the kit can comprise instructions for the use of the kit for any of said embodiments, in particular for the use for producing organisms or part thereof having an increased free or bound the fine chemical content.

In one embodiment said kit comprises further a nucleic acid molecule encoding one or more of the aforementioned protein, and/or an antibody, a vector, a host cell, an antisense nucleic acid, a plant cell or plant tissue or a plant.

In a further embodiment, the present invention relates to a method for the production of a agricultural composition providing the nucleic acid molecule, the vector or the polypeptide of the invention or comprising the steps of the method according to the invention for the identification of said compound, agonist or antagonist; and formulating the nucleic acid molecule, the vector or the polypeptide of the invention or the agonist, or compound identified according to the methods or processes of the present invention or with use of the subject matters of the present invention in a form applicable as plant agricultural composition.

In another embodiment, the present invention relates to a method for the production of a "the fine chemical"-production supporting plant culture composition comprising the steps of the method for of the present invention; and formulating the compound identified in a form acceptable as agricultural composition.

Under "acceptable as agricultural composition" is understood, that such a composition is in agreement with the laws regulating the content of fungicides, plant nutrients, herbizides, etc. Preferably such a composition is without any harm for the protected plants and the animals (humans included) fed therewith.

The present invention also pertains to several embodiments relating to further uses and methods. The nucleic acid molecule, polypeptide, protein homologues, fusion proteins, primers, vectors, host cells, described herein can be used in one or more of the following methods: identification of plants useful for fine chemical production as mentioned and related organisms; mapping of genomes; identification and localization of sequences of interest; evolutionary studies; determination of regions required for function; modulation of an activity.

The nucleic acid molecule of the invention, the vector of the invention or the nucleic acid construct of the invention may also be useful for the production of organisms resistant to inhibitors of the fine chemical e.g. the amino acid production biosynthesis pathways. In particular, the overexpression of the polypeptide of the present invention may protect plants against herbicides, which block the amino acid, in particular the fine chemical, synthesis in said plant. Examples of herbicides blocking the fine chemical synthesis e.g. the amino acid synthesis in plants are for example sulfonylurea and imidazolinone herbicides which catalyze the first step in branched-chain amino acid biosynthesis Accordingly, the nucleic acid molecules of the present invention have a variety of uses. First, they may be used to identify an organism or a close relative thereof. Also, they may be used to identify the presence thereof or a relative thereof in a mixed population of microorganisms or plants. By probing the extracted genomic DNA of a culture of a unique or mixed population of plants under stringent conditions with a probe spanning a region of the gene of the present invention which is unique to this, one can ascertain whether the present invention has been used or whether it or a close relative is present.

Further, the nucleic acid molecule of the invention may be sufficiently homologous to the sequences of related species such that these nucleic acid molecules may serve as markers for the construction of a genomic map in related organism.

Accordingly, the present invention relates to a method for breeding plants for the production of the fine chemical, comprising
(a) providing a first plant variety produced according to the process of the invention preferably (over)expressing the nucleic acid molecule of the invention;
(b) crossing the first plant variety with a second plant variety; and
(c) selecting the offspring plants which overproduce the fine chemical by means of analysis the distribution of a molecular marker in the offspring representing the first plant variety and its capability to (over)produce the fine chemical.

Details about the use of molecular markers in breeding can be found in Kumar et al., 1999 (Biotech Adv., 17:143-182) and Peleman and van der Voort 2003 (Trends Plant Sci. 2003 July; 8(7):330-334). The molecular marker can e.g. relate to the nucleic acid molecule of the invention and/or its expression level. Accordingly, the molecular marker can be a probe or a PCR primer set useful for identification of the genomic existence or genomic localisation of the nucleic acid molecule of the invention, e.g. in a Southern blot analysis or a PCR or its expression level, i.g. in a Northern Blot analysis or a quantitative PCR. Accordingly, in one embodiment, the present invention relates to the use of the nucleic acid molecule of the present invention or encoding the polypeptide of the present invention as molecular marker for breeding.

The nucleic acid molecules of the invention are also useful for evolutionary and protein structural studies. By comparing the sequences of the invention or used in the process of the invention to those encoding similar enzymes from other organisms, the evolutionary relatedness of the organisms can be assessed. Similarly, such a comparison permits an assessment of which regions of the sequence are conserved and which are not, which may aid in determining those regions of the protein which are essential for the functioning of the enzyme. This type of determination is of value for protein engineering studies and may give an indication of what the protein can tolerate in terms of mutagenesis without losing function.

Accordingly, the nucleic acid molecule of the invention can be used for the identification of other nucleic acids conferring an increase of the fine chemical after expression.

Further, the nucleic acid molecule of the invention or a fragment of a gene conferring the expression of the polypeptide of the invention, preferably comprising the nucleic acid molecule of the invention, can be used for marker assisted breeding or association mapping of the fine chemical derived traits Accordingly, the nucleic acid of the invention, the polypeptide of the invention, the nucleic acid construct of the invention, the organisms, the host cell, the microorgansims, the plant, plant tissue, plant cell, or the part thereof of the invention, the vector of the invention, the agonist identified with the method of the invention, the nucleic acid molecule identified with the method of the present invention, can be used for the production of the fine chemical or of the fine chemical and one or more other ingredients such as amino acids, in particular Threoinine, Alanine, Glutamin, Glutamic acid, Valine, Aspargine, Phenylalanine, Leucine, Proline, Tryptophan Tyrosine, Valine, Isoleucine and Arginine.

Accordingly, the nucleic acid of the invention, or the nucleic acid molecule identified with the method of the present invention or the complement sequences thereof, the polypeptide of the invention, the nucleic acid construct of the invention, the organisms, the host cell, the microorgansims, the plant, plant tissue, plant cell, or the part thereof of the invention, the vector of the invention, the antagonist identified with the method of the invention, the antibody of the present invention, the antisense molecule of the present invention, can be used for the reduction of the fine chemical in a organism or part thereof, e.g. in a cell.

Further, the nucleic acid of the invention, the polypeptide of the invention, the nucleic acid construct of the invention, the organisms, the host cell, the microorgansims, the plant, plant tissue, plant cell, or the part thereof of the invention, the vector of the invention, the antagonist or the agonist identified with the method of the invention, the antibody of the presen invention, the antisense molecule of the present invention or the nucleic acid molecule identified with the method of the present invention, can be used for the preparation of an agricultural composition.

Furthermore, the nucleic acid of the invention, the polypeptide of the invention, the nucleic acid construct of the invention, the organisms, the host cell, the microorgansims, the plant, plant tissue, plant cell, or the part thereof of the invention, the vector of the invention, antagonist or the agonist identified with the method of the invention, the antibody of the presen invention, the antisense molecule of the present invention or the nucleic acid molecule identified with the method of the present invention, can be used for the identification and production of compounds capable of conferring a modulation of the fine chemical levels in an organism or parts thereof, preferably to identify and produce compounds conferring an increase of the fine chemical levels in an organism or parts thereof, if said identified compound is applied to the organism or part thereof, i.e. as part of its food, or in the growing or culture media.

These and other embodiments are disclosed and encompassed by the description and examples of the present invention. Further literature concerning any one of the methods, uses and compounds to be employed in accordance with the present invention may be retrieved from public libraries, using for example electronic devices. For example the public database "Medline" may be utilized which is available on the Internet. Further databases and addresses are known to the person skilled in the art. An overview of patent information in biotechnology and a survey of relevant sources of patent information useful for retrospective searching and for current awareness are given in Berks, TIBTECH 12 (1994), 352-364.

Table 1 gives an overview about the fine chemicals produced by SEQ ID NO: 1 of the present invention.

TABLE 1

Fine chemicals produced with SEQ ID NO: 1 (YNL090W)

| Metabolite | Method | Min | Max |
|---|---|---|---|
| Tryptophane | LC | 1.26 | 4.39 |
| Proline | LC | 1.73 | 6.29 |
| Arginine | LC | 1.54 | 4.23 |
| Raffinose | LC | 2.57 | 16.05 |
| Ferulic Acid | LC | 1.40 | 2.41 |
| Phenylalanine | LC | 1.34 | 2.75 |
| Tyrosine | LC | 1.44 | 2.55 |
| gamma + beta – Tocopherol | LC | 0.36 | 0.66 |
| Cerotic Acid (C26:0) | GC | 1.41 | 3.78 |
| Lignoceric Acid (C24:0) | GC | 1.34 | 2.14 |
| Alanine | GC | 1.21 | 1.57 |
| Glycine | GC | 1.46 | 1.67 |
| Threonine | GC | 1.21 | 2.02 |
| Putrescine | GC | 0.18 | 0.42 |
| Serine | GC | 1.29 | 1.96 |
| Valine | GC | 1.20 | 2.31 |
| Isoleucine | GC | 1.30 | 4.35 |
| Leucine | GC | 1.51 | 5.01 |
| Sinapic Acid | GC | 1.28 | 2.08 |

TABLE 1-continued

Fine chemicals produced with SEQ ID NO: 1 (YNL090W)

| Metabolite | Method | Min | Max |
|---|---|---|---|
| 3,4-Dihydroxyphenylalanine (=DOPA) | GC | 1.37 | 1.87 |
| Stearic Acid (C18:0) | GC | 1.16 | 2.13 |
| beta-Carotene | LC | 1.77 | 2.68 |

Column 1 shows the metabolite produced. Column 2 mirrors the analytic method and column 3 and 4 shows the minimum and maximum production of the respective fine chemical as x-fold.

The present invention is illustrated by the examples, which follow. The present examples illustrate the basic invention without being intended as limiting the subject of the invention. The content of all of the references, patent applications, patents and published patent applications cited in the present patent application is herewith incorporated by reference.

EXAMPLES

Example 1

Cloning SEQ ID NO: 1 in *Escherichia coli*

SEQ ID NO: 1 was cloned into the plasmids pBR322 (Sutcliffe, J. G. (1979) Proc. Natl Acad. Sci. USA, 75: 3737-3741); pACYC177 (Change & Cohen (1978) J. Bacteriol. 134: 1141-1156); plasmids of the pBS series (pBSSK+, pBSSK− and others; Stratagene, LaJolla, USA) or cosmids such as SuperCos1 (Stratagene, LaJolla, USA) or Lorist6 (Gibson, T. J. Rosenthal, A., and Waterson, R. H. (1987) Gene 53: 283-286) for expression in *E. coli* using known, well-established procedures (see, for example, Sambrook, J. et al. (1989) "Molecular Cloning: A Laboratory Manual". Cold Spring Harbor Laboratory Press or Ausubel, F. M. et al. (1994) "Current Protocols in Molecular Biology", John Wiley & Sons).

Example 2

DNA Sequencing and Computerized Functional Analysis

The DNA was sequenced by standard procedures, in particular the chain determination method, using ABI377 sequencers (see, for example, Fleischman, R. D. et al. (1995) "Whole-genome Random Sequencing and Assembly of *Haemophilus* Influenzae Rd., Science 269; 496-512)".

Example 3

In-Vivo Mutagenesis

An in vivo mutagenesis of *Corynebacterium glutamicum* for the production of amino acids can be carried out by passing a plasmid DNA (or another vector DNA) through *E. coli* and other microorganisms (for example *Bacillus* spp. or yeasts such as *Saccharomyces cerevisiae*), which are not capable of maintaining the integrity of its genetic information. Usual mutator strains have mutations in the genes for the DNA repair system [for example mutHLS, mutD, mutT and the like; for comparison, see Rupp, W. D. (1996) DNA repair mechanisms in *Escherichia coli* and *Salmonella*, pp. 2277-2294, ASM: Washington]. The skilled worker knows these strains. The use of these strains is illustrated for example in Greener, A. and Callahan, M. (1994) Strategies 7; 32-34.

Example 4

DNA Transfer between *Escherichia coli* and *Corynebacterium Glutamicum*

Several *Corynebacterium* and *Brevibacterium* species comprise endogenous plasmids (such as, for example, pHM1519 or pBL1), which replicate autonomously (for a review, see, for example, Martin, J. F. et al. (1987) Biotechnology 5: 137-146). Shuttle vectors for *Escherichia coli* and *Corynebacterium glutamicum* can be constructed easily using standard vectors for *E. coli* (Sambrook, J. et al., (1989), "Molecular Cloning: A Laboratory Manual", Cold Spring Harbor Laboratory Press or Ausubel, F. M. et al. (1994) "Current Protocols in Molecular Biology", John Wiley & Sons), which have a replication origin for, and suitable marker from, *Corynebacterium glutamicum* added. Such replication origins are preferably taken from endogenous plasmids, which have been isolated from *Corynebacterium* and *Brevibacterium* species. Genes, which are used in particular as transformation markers for these species are genes for kanamycin resistance (such as those which originate from the Tn5 or Tn-903 transposon) or for chloramphenicol resistance (Winnacker, E. L. (1987) "From Genes to Clones—Introduction to Gene Technology, VCH, Weinheim). There are many examples in the literature of the preparation of a large multiplicity of shuttle vectors which are replicated in *E. coli* and *C. glutamicum* and which can be used for various purposes including the overexpression of genes (see, for example, Yoshihama, M. et al. (1985) J. Bacteriol. 162: 591-597, Martin, J. F. et al., (1987) Biotechnology, 5: 137-146 and Eikmanns, B. J. et al. (1992) Gene 102: 93-98). Suitable vectors which replicate in coryneform bacteria are for example, pZ1 (Menkel et al., Appl. Environ. Microbiol., 64, 1989: 549-554) pEkEx1 (Eikmanns et al., Gene 102, 1991: 93-98) or pHS2-1 (Sonnen et al, Gene 107, 1991: 69-74). These vectors are based on the cryptic plasmids pHM1519, pBL1 or pGA1. Other plasmid vectors such as, for example, those based on pCG4 (U.S. Pat. No. 4,489,160), pNG2 (Serwold-Davis et al., FEMS Microbiol. Lett., 66, 1990: 119-124) or pAG1 (U.S. Pat. No. 5,158,891) can be used in the same manner.

Using standard methods, it is possible to clone a gene of interest into one of the above-described shuttle vectors and to introduce such hybrid vectors into *Corynebacterium glutamicum* strains. The transformation of *C. glutamicum* can be achieved by protoplast transformation (Kastsumata, R. et al., (1984) J. Bacteriol. 159, 306-311), electroporation (Liebl, E. et al., (1989) FEMS Microbiol. Letters, 53: 399-303) and in those cases where specific vectors are used also by conjugation (such as, for example, described in Schäfer, A., et al. (1990) J. Bacteriol. 172: 1663-1666). Likewise, it is possible to transfer the shuttle vectors for *C. glutamicum* to *E. coli* by preparing plasmid DNA from *C. glutamicum* (using standard methods known in the art) and transforming it into *E. coli*. This transformation step can be carried out using standard methods, but preferably using a Mcr-deficient *E. coli* strain, such as NM522 (Gough & Murray (1983) J. Mol. Biol. 166: 1-19).

If the transformed sequence(s) is/are to be integrated advantageously into the genome of the coryneform bacteria, standard techniques known to the skilled worker also exist for this purpose. Examples, which are used for this purpose are plasmid vectors as they have been described by Remscheid et al. (Appl. Environ. Microbiol., 60, 1994: 126-132) for the duplication and amplification of the hom-thrB operon. In this method, the complete gene is cloned into a plasmid vector, which is capable of replication in a host such as *E. coli*, but not in *C. glutamicum*. Suitable vectors are, for example, pSUP301 (Simon et al., Bio/Technology 1, 1983: 784-791), pK1Bmob or pK19mob (Schäfer et al., Gene 145, 1994: 69-73), pGEM-T (Promega Corp., Madison, Wis., USA), pCR2.1-TOPO (Schuman, J. Biol. Chem., 269, 1994: 32678-32684, U.S. Pat. No. 5,487,993), pCR® Blunt (Invitrogen, Groningen, the Netherlands) or pEM1 (Schrumpf et al., J. Bacteriol., 173, 1991: 4510-4516).

Example 5

Determining the Expression of the Mutant/Transgenic Protein

The observations of the acivity of a mutated, or transgenic, protein in a transformed host cell are based on the fact that the protein is expressed in a similar manner and in a similar quantity as the wild-type protein. A suitable method for determining the transcription quantity of the mutant, or transgenic, gene (a sign for the amount of mRNA which is available for the translation of the gene product) is to carry out a Northern blot (see, for example, Ausubel et al., (1988) Current Protocols in Molecular Biology, Wiley: New York), where a primer which is designed in such a way that it binds to the gene of interest is provided with a detectable marker (usually a radioactive or chemiluminescent marker) so that, when the total RNA of a culture of the organism is extracted, separated on a gel, applied to a stable matrix and incubated with this probe, the binding and quantity of the binding of the probe indicates the presence and also the amount of mRNA for this gene. Another method is a quantitative PCR. This information detects the extent to which the gene has been transcribed. Total cell RNA can be isolated from *Corynebacterium glutamicum* by a variety of methods, which are known in the art, as described in Bormann, E. R. et al., (1992) Mol. Microbiol. 6: 317-326.

Standard techniques, such as Western blot, may be employed to determine the presence or relative amount of protein translated from this mRNA (see, for example, Ausubel et al. (1988) "Current Protocols in Molecular Biology", Wiley, New York). In this method, total cell proteins are extracted, separated by gel electrophoresis, transferred to a matrix such as nitrocellulose and incubated with a probe, such as an antibody, which binds specifically to the desired protein. This probe is usually provided directly or indirectly with a chemiluminescent or calorimetric marker, which can be detected readily. The presence and the observed amount of marker indicate the presence and the amount of the sought mutant protein in the cell. However, other methods are also known.

Example 6

Growth of Genetically Modified *Corynebacterium glutamicum*: Media and Culture Conditions Genetically modified Corynebacteria are grown in synthetic or natural growth media. A number of different growth media for Corynebacteria are known and widely available (Lieb et al. (1989) Appl. Microbiol. Biotechnol. 32: 205-210; von der Osten et al. (1998) Biotechnology Letters 11: 11-16; Patent DE 4 120 867; Liebl (1992) "The Genus *Corynebacterium*", in: The Procaryotes, Vol. II, Balows, A., et al., Ed. Springer-Verlag).

Said media which can be used according to the invention usually consist of one or more carbon sources, nitrogen sources, inorganic salts, vitamins and trace elements. Preferred carbon sources are sugars such as mono-, di- or polysaccharides. Examples of very good carbon sources are glucose, fructose, mannose, galactose, ribose, sorbose, ribulose, lactose, maltose, sucrose, raffinose, starch or cellulose. Sugars may also be added to the media via complex compounds such as molasses or other by-products of sugar refining. It may also be advantageous to add mixtures of various carbon sources. Other possible carbon sources are alcohols and/or organic acids such as methanol, ethanol, acetic acid or lactic acid. Nitrogen sources are usually organic or inorganic nitrogen compounds or materials containing said compounds. Examples of nitrogen sources include ammonia gas, aqueous ammonia solutions or ammonium salts such as $NH_4Cl$, or $(NH_4)_2SO_4$, $NH_4OH$, nitrates, urea, amino acids or complex nitrogen sources such as cornsteep liquor, soybean flour, soybean protein, yeast extract, meat extract and others. Mixtures of the above nitrogen sources may be used advantageously.

Inorganic salt compounds, which may be included in the media comprise the chloride, phosphorus or sulfate salts of calcium, magnesium, sodium, cobalt, molybdenum, potassium, manganese, zinc, copper and iron. Chelating agents may be added to the medium in order to keep the metal ions in solution. Particularly suitable chelating agents include dihydroxyphenols such as catechol or protocatechulate or organic acids such as citric acid. The media usually also contain other growth factors such as vitamins or growth promoters, which include, for example, biotin, riboflavin, thiamine, folic acid, nicotinic acid, panthothenate and pyridoxine. Growth factors and salts are frequently derived from complex media components such as yeast extract, molasses, cornsteep liquor and the like. The exact composition of the compounds used in the media depends heavily on the particular experiment and is decided upon individually for each specific case. Information on the optimization of media can be found in the textbook "Applied Microbiol. Physiology, A Practical Approach" (Ed. P. M. Rhodes, P. F. Stanbury, IRL Press (1997) S. 53-73, ISBN 0 19 963577 3). Growth media can also be obtained from commercial suppliers, for example Standard 1 (Merck) or BHI (Brain heart infusion, DIFCO) and the like.

All media components are sterilized, either by heat (20 min at 1.5 bar und 121° C.) or by filter sterilization. The components may be sterilized either together or, if required, separately. All media components may be present at the start of the cultivation or added continuously or batchwise, as desired.

The culture conditions are defined separately for each experiment. The temperature is normally between 15° C. and 45° C. and may be kept constant or may be altered during the experiment. The pH of the medium should be in the range from 5 to 8.5, preferably around 7.0, and can be maintained by adding buffers to the media. An example of a buffer for this purpose is a potassium phosphate buffer. Synthetic buffers such as MOPS, HEPES, ACES and the like may be used as an alternative or simultaneously. The culture pH value may also be kept constant during the culture period by addition of, for example, NaOH or $NH_4OH$. If complex media components such as yeast extract are used, additional buffers are required less since many complex compounds have a high buffer capacity. When using a fermenter for the culture of microorganisms, the pH value can also be regulated using gaseous ammonia.

The incubation period is generally in a range of from several hours to several days. This time period is selected in such a way that the maximum amount of product accumulates in the fermentation broth. The growth experiments, which are disclosed can be carried out in a multiplicity of containers such as microtiter plates, glass tubes, glass flasks or glass or metal fermenters of various sizes. To screen a large number of clones, the microorganisms should be grown in microtiter plates, glass tubes or shake flasks, either using simple flasks or baffle flasks. 100 ml shake flasks filled with 10% (based on the volume) of the growth medium required are preferably used. The flasks should be shaken on an orbital shaker (amplitude 25 mm) at a rate ranging from 100 to 300 rpm. Evaporation losses can be reduced by maintaining a humid atmosphere; as an alternative, a mathematical correction should be carried out for the evaporation losses.

If genetically modified clones are examined, an unmodified control clone, or a control clone, which contains the basic plasmid without insertion, should also be included in the tests. If a transgenic sequence is expressed, a control clone should advantageously again be included in these tests. The medium is advantageously inoculated to an OD600 of 0.5 to 1.5 using cells which have been grown on agar plates, such as CM plates (10 g/l glucose, 2.5 g/l NaCl, 2 g/l urea, 10 g/l polypeptone, 5 g/l yeast extract, 5 g/l meat extract, 22 g/l agar, pH value 6.8 established with 2M NaOH), which have been incubated at 30° C. The media are inoculated either by introducing a saline solution of *C. glutamicum* cells from CM plates or by addition of a liquid preculture of this bacterium.

Example 7

In-Vitro Analysis of the Function of the Proteins Encoded by the Transformed Sequences The determination of the activities and kinetic parameters of enzymes is well known in the art. Experiments for determining the activity of a specific modified enzyme must be adapted to the specific activity of the wild-enzyme type, which is well within the capabilities of the skilled worker. Overviews of enzymes in general and specific details regarding the structure, kinetics, principles, methods, applications and examples for the determination of many enzyme activities can be found for example in the following literature: Dixon, M., and Webb, E. C: (1979) Enzymes, Longmans, London; Fersht (1985) Enzyme Structure and Mechanism, Freeman, New York; Walsh (1979) Enzymatic Reaction Mechanisms. Freeman, San Francisco; Price, N. C., Stevens, L. (1982) Fundamentals of Enzymology. Oxford Univ. Press: Oxford; Boyer, P. D: Ed. (1983) The Enzymes, 3rd Ed. Academic Press, New York; Bisswanger, H. (1994) Enzymkinetik, 2nd Ed. VCH, Weinheim (ISBN 3527300325); Bergmeyer, H. U., Bergmeyer, J., Graβl, M. Ed. (1983-1986) Methods of Enzymatic Analysis, 3rd Ed. Vol. I-XII, Verlag Chemie: Weinheim; and Ullmann's Encyclopedia of Industrial Chemistry (1987) Vol. A9, "Enzymes", VCH, Weinheim, pp. 352-363.

Example 8

Analysis of the Effect of the Nucleic Acid Molecule on the Production of the Amino Acids The effect of the genetic modification in *C. glutamicum* on the production of an amino acid can be determined by growing the modified microorganisms under suitable conditions (such as those described above) and analyzing the medium and/or the cellular components for the increased production of the amino acid. Such analytical techniques are well known to the skilled worker and encompass spectroscopy, thin-layer chromatography, various types of staining methods, enzymatic and microbiological methods and analytical chromatography such as high-performance liquid chromatography (see, for example, Ullman, Encyclopedia of Industrial Chemistry, Vol. A2, pp. 89-90 and pp. 443-613, VCH: Weinheim (1985); Fallon, A., et al., (1987) "Applications of HPLC in Biochemistry" in: Laboratory Techniques in Biochemistry and Molecular Biology, Vol. 17; Rehm et al. (1993) Biotechnology, Vol. 3, Chapter III: "Product recovery and purification", pp. 469-714, VCH: Weinheim; Belter, P. A. et al. (1988) Bioseparations: downstream processing for Biotechnology, John Wiley and Sons; Kennedy, J. F. and Cabral, J. M. S. (1992) Recovery processes for biological Materials, John Wiley and Sons; Shaeiwitz, J. A. and Henry, J. D. (1988) Biochemical Separations, in Ullmann's Encyclopedia of Industrial Chemistry, Vol. B3; chapter 11, pp. 1-27, VCH: Weinheim; and Dechow, F. J. (1989) Separation and purification techniques in biotechnology, Noyes Publications).

In addition to the determination of the fermentation end product, other components of the metabolic pathways which are used for the production of the desired compound, such as intermediates and by-products, may also be analyzed in order to determine the total productivity of the organism, the yield and/or production efficiency of the compound. The analytical methods encompass determining the amounts of nutrients in the medium (for example sugars, hydrocarbons, nitrogen sources, phosphate and other ions), determining biomass composition and growth, analyzing the production of ordinary metabolites from biosynthetic pathways and measuring gases generated during the fermentation. Standard methods for these are described in Applied Microbial Physiology; A Practical Approach, P. M. Rhodes and P. F. Stanbury, Ed. IRL Press, pp. 103-129; 131-163 and 165-192 (ISBN: 0199635773) and the references cited therein.

Example 9

Purification of the Amino Acid

The amino acid can be recovered from cells or from the supernatant of the above-described culture by a variety of methods known in the art. For example, the culture supernatant is recovered first. To this end, the cells are harvested from the culture by slow centrifugation. Cells can generally be disrupted or lysed by standard techniques such as mechanical force or sonication. The cell debris is removed by centrifugation and the supernatant fraction, if appropriate together with the culture supernatant, is used for the further purification of the amino acid. However, it is also possible to process the supernatant alone if the amino acid is present in the supernatant in sufficiently high a concentration. In this case, the amino acid, or the amino acid mixture, can be purified further for example via extraction and/or salt precipitation or via ion-exchange chromatography.

If required and desired, further chromatography steps with a suitable resin may follow, the amino acid, but not many contaminants in the sample, being retained on the chromatography resin or the contaminants, but not the sample with the product (amino acid), being retained on the resin. If necessary, these chromatography steps may be repeated, using identical or other chromatography resins. The skilled worker is familiar with the selection of suitable chromatography resin and the most effective use for a particular molecule to be purified. The purified product can be concentrated by filtration or ultrafiltration and stored at a temperature at which maximum product stability is ensured. Many purification methods, which are not limited to the above purification method are known in the art. They are described, for example, in Bailey, J. E. & Ollis, D. F. Biochemical Engineering Fundamentals, McGraw-Hill: New York (1986).

Identity and purity of the amino acid isolated can be determined by standard techniques of the art. They encompass high-performance liquid chromatography (HPLC), spectroscopic methods, mass spectrometry (MS), staining methods, thin-layer chromatography, NIRS, enzyme assay or microbiological assays. These analytical methods are compiled in: Patek et al. (1994) Appl. Environ. Microbiol. 60: 133-140; Malakhova et al. (1996) Biotekhnologiya 11: 27-32; and Schmidt et al. (1998) Bioprocess Engineer. 19: 67-70. Ulmann's Encyclopedia of Industrial Chemistry (1996) Vol. A27, VCH: Weinheim, pp. 89-90, pp. 521-540, pp. 540-547, pp. 559-566, 575-581 and pp. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Vol. 17.

Example 10

Cloning SEQ ID NO: 1 for the Expression in Plants

Unless otherwise specified, standard methods as described in Sambrook et al., Molecular Cloning: A laboratory manual, Cold Spring Harbor 1989, Cold Spring Harbor Laboratory Press are used.

SEQ ID NO: 1 is amplified by PCR as described in the protocol of the Pfu Turbo or DNA Herculase polymerase (Stratagene).

The composition for the protocol of the Pfu Turbo DNA polymerase was as follows: 1×PCR buffer (Stratagene), 0.2 mM of each dNTP, 100 ng genomic DNA of *Saccharomyces cerevisiae* (strain S288C; Research Genetics, Inc., now Invitrogen) or *Escherichia coli* (strain MG1655; *E. coli* Genetic Stock Center), 50 pmol forward primer, 50 pmol reverse primer, 2.5 u Pfu Turbo DNA polymerase. The amplification cycles were as follows:
1 cycle of 3 minutes at 94-95° C., followed by 25-36 cycles of in each case 1 minute at 95° C. or 30 seconds at 94° C., 45 seconds at 50° C., 30 seconds at 50° C. or 30 seconds at 55° C. and 210-480 seconds at 72° C., followed by 1 cycle of 8 minutes at 72° C., then 4° C.

The composition for the protocol of the Herculase polymerase was as follows: 1×PCR buffer (Stratagene), 0.2 mM of each dNTP, 100 ng genomic DNA of *Saccharomyces cerevisiae* (strain S288C; Research Genetics, Inc., now Invitrogen) or *Escherichia coli* (strain MG1655; *E. coli* Genetic Stock Center), 50 pmol forward primer, 50 pmol reverse primer, 2.5 u Herculase polymerase. The amplification cycles were as follows:
1 cycle of 2-3 minutes at 94° C., followed by 25-30 cycles of in each case 30 seconds at 94° C., 30 seconds at 55-60° C. and 5-10 minutes at 72° C., followed by 1 cycle of 10 minutes at 72° C., then 4° C.

The following primer sequences were selected for the gene SEQ ID NO: 1:

```
i) forward primer
                                    (SEQ ID NO: 53)
5'-ATGTCTGAAAAGGCCGTTAGAAGG-3' ii) reverse primer
                                    (SEQ ID NO: 54)
5'-TTATAAAATTATGCAACAGTTAGCCC-3'
```

Thereafter, the amplificate was purified over QIAquick columns following the standard protocol (Qiagen).

For the cloning of PCR-products, produced by Pfu Turbo DNA polymerase, the vector DNA (30 ng) was restricted with SmaI following the standard protocol (MBI Fermentas) and stopped by addition of high-salt buffer. The restricted vector fragments were purified via Nucleobond columns using the standard protocol (Macherey-Nagel). Thereafter, the linearized vector was dephosphorylated following the standard protocol (MBI Fermentas).

The PCR-products, produced by Pfu Turbo DNA polymerase, were directly cloned into the processed binary vector.

The DNA termini of the PCR-products, produced by Herculase DNA polymerase, were blunted in a second synthesis reaction using Pfu Turbo DNA polymerase. The composition for the protocol of the blunting the DNA-termini was as follows: 0.2 mM blunting dTTP and 1.25 u Pfu Turbo DNA polymerase. The reaction was incubated at 72° C. for 30 minutes. Then the PCR-products were cloned into the processed vector as well.

A binary vector comprising a selection cassette (promoter, selection marker, terminator) and an expression cassette with promoter, cloning cassette and terminator sequence between the T-DNA border sequences was used. In addition to those within the cloning cassette, the binary vector has no SmaI cleavage site. Binary vectors which can be used are known to the skilled worker; an overview of binary vectors and their use can be found in Hellens, R., Mullineaux, P. and Klee H., [(2000) "A guide to *Agrobacterium* binary vectors", Trends in Plant Science, Vol. 5 No. 10, 446-451. Depending on the vector used, cloning may advantageously also be carried out via other restriction enzymes. Suitable advantageous cleavage sites can be added to the ORF by using suitable primers for the PCR amplification.

Approximately 30 ng of prepared vector and a defined amount of prepared amplificate were mixed and ligated by addition of ligase.

The ligated vectors were transformed in the same reaction vessel by addition of competent *E. coli* cells (strain DH5alpha) and incubation for 20 minutes at 1° C. followed by a heat shock for 90 seconds at 42° C. and cooling to 4° C. Then, complete medium (SOC) was added and the mixture was incubated for 45 minutes at 37° C. The entire mixture was subsequently plated onto an agar plate with antibiotics (selected as a function of the binary vector used) and incubated overnight at 37° C.

The outcome of the cloning step was verified by amplification with the aid of primers which bind upstream and downstream of the integration site, thus allowing the amplification of the insertion. In addition combinations of the above mentioned gene specific primers and upstream and downstream primers were used in PCR reactions to identify clones with the correct insert orientation. The amplifications were carried as described in the protocol of Taq DNA polymerase (Gibco-BRL).

The amplification cycles were as follows: 1 cycle of 5 minutes at 94° C., followed by 35 cycles of in each case 15 seconds at 94° C., 15 seconds at 50-66° C. and 5 minutes at 72° C., followed by 1 cycle of 10 minutes at 72° C., then 4° C.

Several colonies were checked, but only one colony for which a PCR product of the expected size was detected was used in the following steps.

A portion of this positive colony was transferred into a reaction vessel filled with complete medium (LB) and incubated overnight at 37° C. The LB medium contained an antibiotic chosen to suit the binary vector (see above) used and the resistance gene present therein in order to select the clone.

The plasmid preparation was carried out as specified in the Qiaprep standard protocol (Qiagen).

Example 11

Generation of Transgenic Plants which Express SEQ ID NO: 1

1 ng of the plasmid DNA isolated was transformed by electroporation into competent cells of *Agrobacterium tumefaciens*, of strain GV 3101 pMP90 (Koncz and Schell, Mol. Gen. Gent. 204, 383-396, 1986). The choice of the agrobacterial strain depends on the choice of the binary vector. An overview of possible strains and their properties is found in Hellens, R., Mullineaux, P. and Klee H., (2000)" A guide to *Agrobacterium* binary vectors, Trends in Plant Science, Vol. 5 No. 10, 446-451. Thereafter, complete medium (YEP) was added and the mixture was transferred into a fresh reaction vessel for 3 hours at 28° C. Thereafter, all of the reaction mixture was plated onto YEP agar plates supplemented with the respective antibiotics, for example rifampicin and gentamycin for GV3101 pMP90, and a further antibiotic for the selection onto the binary vector, was plated, and incubated for 48 hours at 28° C.

The agrobacteria generated in Example 10, which contains the plasmid construct were then used for the transformation of plants.

A colony was picked from the agar plate with the aid of a pipette tip and taken up in 3 ml of liquid TB medium, which also contained suitable antibiotics, depending on the agrobacterial strain and the binary plasmid. The preculture was grown for 48 hours at 28° C. and 120 rpm.

400 ml of LB medium containing the same antibiotics as above were used for the main culture. The preculture was transferred into the main culture. It was grown for 18 hours at 28° C. and 120 rpm. After centrifugation at 4000 rpm, the pellet was resuspended in infiltration medium (MS medium, 10% sucrose).

In order to grow the plants for the transformation, dishes (Piki Saat 80, green, provided with a screen bottom, 30×20× 4.5 cm, from Wiesauplast, Kunststofftechnik, Germany) were half-filled with a GS 90 substrate (standard soil, Werkverband E.V., Germany). The dishes were watered overnight with 0.05% Proplant solution (Chimac-Apriphar, Belgium). *Arabidopsis thaliana* C24 seeds (Nottingham *Arabidopsis* Stock Centre, UK; NASC Stock N906) were scattered over the dish, approximately 1000 seeds per dish. The dishes were covered with a hood and placed in the stratification facility (8 h, 110µ µmol/m$^2$/s$^{-1}$, 22° C.; 16 h, dark, 6° C.). After 5 days, the dishes were placed into the short-day controlled environment chamber (8 h 130 µmol/m$^2$/s$^{-1}$, 22° C.; 16 h, dark 20° C.), where they remained for approximately 10 days until the first true leaves had formed.

The seedlings were transferred into pots containing the same substrate (Teku pots, 7 cm, LC series, manufactured by Pöppelmann GmbH & Co, Germany). Five plants were pricked out into each pot. The pots were then returned into the short-day controlled environment chamber for the plant to continue growing.

After 10 days, the plants were transferred into the greenhouse cabinet (supplementary illumination, 16 h, 340 µE, 22° C.; 8 h, dark, 20° C.), where they were allowed to grow for further 17 days.

For the transformation, 6-week-old *Arabidopsis* plants which had just started flowering were immersed for 10 seconds into the above-described agrobacterial suspension which had previously been treated with 10 µl Silwett L77

(Crompton S.A., Osi Specialties, Switzerland). The method in question is described in Clough and Bent, 1998 (Clough, J C and Bent, A F. 1998 Floral dip: a simplified method for *Agrobacterium*-mediated transformation of *Arabidopsis thaliana*, Plant J. 16:735-743.

The plants were subsequently placed for 18 hours into a humid chamber. Thereafter, the pots were returned to the greenhouse for the plants to continue growing. The plants remained in the greenhouse for another 10 weeks until the seeds were ready for harvesting.

Depending on the resistance marker used for the selection of the transformed plants the harvested seeds were planted in the greenhouse and subjected to a spray selection or else first sterilized and then grown on agar plates supplemented with the respective selection agent. In case of BASTA®-resistance, plantlets were sprayed four times at an interval of 2 to 3 days with 0.02% BASTA® and transformed plants were allowed to set seeds. The seeds of the transgenic *A. thaliana* plants were stored in the freezer (at −20° C.).

Example 12

Plant Culture for Bioanalytical Analyses

For the bioanalytical analyses of the transgenic plants, the latter were grown uniformly a specific culture facility. To this end the GS-90 substrate as the compost mixture was introduced into the potting machine (Laible System GmbH, Singen, Germany) and filled into the pots. Thereafter, 35 pots were combined in one dish and treated with Previcur. For the treatment, 25 ml of Previcur were taken up in 10 l of tap water. This amount was sufficient for the treatment of approximately 200 pots. The pots were placed into the Previcur solution and additionally irrigated overhead with tap water without Previcur. They were used within four days.

For the sowing, the seeds, which had been stored in the refrigerator (at −20° C.), were removed from the Eppendorf tubes with the aid of a toothpick and transferred into the pots with the compost. In total, approximately 5 to 12 seeds were distributed in the middle of the pot.

After the seeds had been sown, the dishes with the pots were covered with matching plastic hood and placed into the stratification chamber for 4 days in the dark at 4° C. The humidity was approximately 90%. After the stratification, the test plants were grown for 22 to 23 days at a 16-h-light, 8-h-dark rhythm at 20° C., an atmospheric humidity of 60% and a $CO_2$ concentration of approximately 400 ppm. The light sources used were Powerstar HQI-T 250 W/D Daylight lamps from Osram, which generate a light resembling the solar color spectrum with a light intensity of approximately 220 µE/m2/s-1.

When the plants were 8, 9 and 10 days old, they were subjected to selection for the resistance marker Approximately 1400 pots with transgenic plants were treated with 1 l 0.015% vol/vol of Basta® (Glufosinate-ammonium) solution in water (Aventis Cropsience, GermanyAfter a further 3 to 4 days, the transgenic, resistant seedlings (plantlets in the 4-leaf stage) could be distinguished clearly from the untransformed plantlets. The nontransgenic seedlings were bleached or dead. The transgenic resistance plants were thinned when they had reached the age of 14 days. The plants, which had grown best in the center of the pot were considered the target plants. All the remaining plants were removed carefully with the aid of metal tweezers and discarded.

During their growth, the plants received overhead irrigation with distilled water (onto the compost) and bottom irrigation into the placement grooves. Once the grown plants had reached the age of 23 days, they were harvested.

Example 13

Metabolic Analysis of Transformed Plants

The modifications identified in accordance with the invention, in the content of above-described metabolites, were identified by the following procedure.

a) Sampling and Storage of the Samples

Sampling was performed directly in the controlled-environment chamber. The plants were cut using small laboratory scissors, rapidly weighed on laboratory scales, transferred into a pre-cooled extraction sleeve and placed into an aluminum rack cooled by liquid nitrogen. If required, the extraction sleeves can be stored in the freezer at −80° C. The time elapsing between cutting the plant to freezing it in liquid nitrogen amounted to not more than 10 to 20 seconds.

b) Lyophilization

During the experiment, care was taken that the plants either remained in the deep-frozen state (temperatures<−40° C.) or were freed from water by lyophilization until the first contact with solvents.

The aluminum rack with the plant samples in the extraction sleeves was placed into the pre-cooled (−40° C.) lyophilization facility. The initial temperature during the main drying phase was −35° C. and the pressure was 0.120 mbar. During the drying phase, the parameters were altered following a pressure and temperature program. The final temperature after 12 hours was +30° C. and the final pressure was 0.001 to 0.004 mbar. After the vacuum pump and the refrigerating machine had been switched off, the system was flushed with air (dried via a drying tube) or argon.

c) Extraction

Immediately after the lyophilization apparatus had been flushed, the extraction sleeves with the lyophilized plant material were transferred into the 5 ml extraction cartridges of the ASE device (Accelerated Solvent Extractor ASE 200 with Solvent Controller and AutoASE software (DIONEX)).

The 24 sample positions of an ASE device (Accelerated Solvent Extractor ASE 200 with Solvent Controller and AutoASE software (DIONEX)) were filled with plant samples, including some samples for testing quality control.

The polar substances were extracted with approximately 10 ml of methanol/water (80/20, v/v) at T=70° C. and p=140 bar, 5 minutes heating-up phase, 1 minute static extraction. The more lipophilic substances were extracted with approximately 10 ml of methanol/dichloromethane (40/60, v/v) at T=70° C. and p=140 bar, 5 minute heating-up phase, 1 minute static extraction. The two solvent mixtures were extracted into the same glass tubes (centrifuge tubes, 50 ml, equipped with screw cap and pierceable septum for the ASE (DIONEX)).

The solution was treated with internal standards: ribitol, L-glycine-2,2-$d_2$, L-alanine-2,3,3,3-$d_4$, methionine-methyl-$d_3$, and α-methylglucopyranoside and methyl nonadecanoate, methyl undecanoate, methyl tridecanoate, methyl pentadecanoate, methyl nonacosanoate.

The total extract was treated with 8 ml of water. The solid residue of the plant sample and the extraction sleeve were discarded.

The extract was shaken and then centrifuged for 5 to 10 minutes at at least 1400 g in order to accelerate phase separation. 1 ml of the supernatant methanol/water phase ("polar phase", colorless) was removed for the further GC analysis, and 1 ml was removed for the LC analysis. The remainder of the methanol/water phase was discarded. 0.5 ml of the organic phase ("lipid phase", dark green) was removed for the further GC analysis and 0.5 ml was removed for the LC analysis. All the portions removed were evaporated to dryness using the IR Dancer infrared vacuum evaporator (Hettich). The maximum temperature during the evaporation process did not exceed 40° C. Pressure in the apparatus was not less than 10 mbar.

d) Processing the Lipid Phase for the LC/MS or LC/MS/MS Analysis

The lipid extract, which had been evaporated to dryness was taken up in mobile phase. The HPLC was run with gradient elution.

The polar extract, which had been evaporated to dryness was taken up in mobile phase. The HPLC was run with gradient elution.

e) Derivatization of the Lipid Phase for the GC/MS Analysis

For the transmethanolysis, a mixture of 140 µl of chloroform, 37 µl of hydrochloric acid (37% by weight HCl in water), 320 µl of methanol and 20 µl of toluene was added to the evaporated extract. The vessel was sealed tightly and heated for 2 hours at 100° C., with shaking. The solution was subsequently evaporated to dryness. The residue was dried completely.

The methoximation of the carbonyl groups was carried out by reaction with methoxyamine hydrochloride (5 mg/ml in pyridine, 100 µl for 1.5 hours at 60° C.) in a tightly sealed vessel. 20 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 100 µl of N-methyl-N-(trimethylsilyl)-2,2,2-trifluoroacetamide (MSTFA) was carried out for 30 minutes at 60° C., again in the tightly sealed vessel. The final volume before injection into the GC was 220 µl.

f) Derivatization of the Polar Phase for the GC/MS Analysis

The methoximation of the carbonyl groups was carried out by reaction with methoxyamine hydrochloride (5 mg/ml in pyridine, 50 µl for 1.5 hours at 60° C.) in a tightly sealed vessel. 10 µl of a solution of odd-numbered, straight-chain fatty acids (solution of each 0.3 mg/mL of fatty acids from 7 to 25 carbon atoms and each 0.6 mg/mL of fatty acids with 27, 29 and 31 carbon atoms in 3/7 (v/v) pyridine/toluene) were added as time standards. Finally, the derivatization with 50 µl of N-methyl-N-(trimethylsilyl)-2,2,2-trifluoroacetamide (MSTFA) was carried out for 30 minutes at 60° C., again in the tightly sealed vessel. The final volume before injection into the GC was 110 µl.

g) Analysis of the Various Plant Samples

The samples were measured in individual series of 20 plant samples each (also referred to as sequences), each sequence containing at least 5 wild-type plants as controls. The peak area of each analyte was divided by the peak area of the respective internal standard. The data were standardized for the fresh weight established for the plant. The values calculated thus were related to the wild-type control group by being divided by the mean of the corresponding data of the wild-type control group of the same sequence. The values obtained were referred to as ratio_by_WT, they are comparable between sequences and indicate how much the analyte concentration in the mutant differs in relation to the wild-type control. Appropiate controls were done before to proof that the vector and transformation procedure itself has no significant influence on the metabolic composition of the plants. Therefore the desribed changes in comparison with wildtypes were caused by the introduced genes.

As an alternative, the amino acids can be detected advantageously via HPLC separation in ethanolic extract as described by Geigenberger et al. (Plant Cell & Environ, 19, 1996: 43-55).

The results of the different plant analyses can be seen from the table 1.

Column 1 in Table 1 shows the amino acid analyzed. Columns 3 and 4 shows the ratio of the analyzed amino acid between the transgenic plants and the wild type; Increase of the metabolites: Max: maximal x-fold (normalised to wild type)–Min: minimal x-fold (normalised to wild type). Decrease of the metabolites: Max: maximal x-fold (normalised to wild type) (minimal decrease), Min: minimal x-fold (normalised to wild type) (maximal decrease). Column 2 indicates the analytical method.

When the analyses were repeated independently, all results proved to be significant.

Example 14a

Engineering Ryegrass Plants by Over-Expressing YNL090W, e.g. from *Saccharomyces cerevisiae* or Plants Seeds of several different ryegrass varieties can be used as explant sources for transformation, including the commercial variety Gunne available from Svalof Weibull seed company or the variety Affinity. Seeds are surface-sterilized sequentially with 1% Tween-20 for 1 minute, 100% bleach for 60 minutes, 3 rinses with 5 minutes each with de-ionized and distilled H2O, and then germinated for 3-4 days on moist, sterile filter paper in the dark. Seedlings are further sterilized for 1 minute with 1% Tween-20, 5 minutes with 75% bleach, and rinsed 3 times with ddH$_2$O, 5 min each.

Surface-sterilized seeds are placed on the callus induction medium containing Murashige and Skoog basal salts and vitamins, 20 g/l sucrose, 150 mg/l asparagine, 500 mg/l casein hydrolysate, 3 g/l Phytagel, 10 mg/l BAP, and 5 mg/l dicamba. Plates are incubated in the dark at 25° C. for 4 weeks for seed germination and embryogenic callus induction.

After 4 weeks on the callus induction medium, the shoots and roots of the seedlings are trimmed away, the callus is transferred to fresh media, is maintained in culture for another 4 weeks, and is then transferred to MSO medium in light for 2 weeks. Several pieces of callus (11-17 weeks old) are either strained through a 10 mesh sieve and put onto callus induction medium, or are cultured in 100 ml of liquid ryegrass callus induction media (same medium as for callus induction with agar) in a 250 ml flask. The flask is wrapped in foil and shaken at 175 rpm in the dark at 23° C. for 1 week. Sieving the liquid culture with a 40-mesh sieve is collected the cells. The fraction collected on the sieve is plated and is cultured on solid ryegrass callus induction medium for 1 week in the dark at 25° C. The callus is then transferred to and is cultured on MS medium containing 1% sucrose for 2 weeks.

Transformation can be accomplished with either *Agrobacterium* or with particle bombardment methods. An expression vector is created containing a constitutive plant promoter and the cDNA of the gene in a pUC vector. The plasmid DNA is prepared from *E. coli* cells using with Qiagen kit according to manufacturer's instruction. Approximately 2 g of embryogenic callus is spread in the center of a sterile filter paper in a Petri dish. An aliquot of liquid MSO with 10 g/l sucrose is added to the filter paper. Gold particles (1.0 µm in size) are coated with plasmid DNA according to method of Sanford et al., 1993 and are delivered to the embryogenic callus with the following parameters: 500 μg particles and 2 μg DNA per shot, 1300 psi and a target distance of 8.5 cm from stopping plate to plate of callus and 1 shot per plate of callus.

After the bombardment, calli are transferred back to the fresh callus development medium and maintained in the dark at room temperature for a 1-week period. The callus is then transferred to growth conditions in the light at 25° C. to initiate embryo differentiation with the appropriate selection agent, e.g. 250 nM Arsenal, 5 mg/l PPT or 50 mg/L Kanamycin. Shoots resistant to the selection agent are appearing and once rooted are transferred to soil.

Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Transgenic T0 ryegrass plants are propagated vegetatively by excising tillers. The transplanted tillers are maintained in the greenhouse for 2 months until well established. The shoots are defoliated and allowed to grow for 2 weeks.

Example 14

Engineering Soybean Plants by Over-Expressing YNL090W, e.g. from *Saccharomyces cerevisiae* or Plants Soybean can be transformed according to the following modification of the method described in the Texas A&M U.S. Pat. No. 5,164,310. Several commercial soybean varieties are amenable to transformation by this method. The cultivar Jack (available from the Illinois Seed Foundation) is commonly used for transformation. Seeds are sterilized by immersion in 70% (v/v) ethanol for 6 min and in 25% commercial bleach (NaOCl) supplemented with 0.1% (v/v) Tween for 20 min, followed by rinsing 4 times with sterile double distilled water. Removing the radicle, hypocotyl and one cotyledon from each seedling propagates seven-day seedlings. Then, the epicotyl with one cotyledon is transferred to fresh germination media in petri dishes and incubated at 25° C. under a 16-hr photoperiod (approx. 100 μE-m-2s-1) for three weeks. Axillary nodes (approx. 4 mm in length) are cut from 3-4 week-old plants. Axillary nodes are excised and incubated in *Agrobacterium* LBA4404 culture.

Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used as described above, including the *Arabidopsis* gene encoding a mutated acetohydroxy acid synthase (AHAS) enzyme (U.S. Pat. Nos. 57,673,666 and 6,225,105). Similarly, various promoters can be used to regulate the trait gene to provide constitutive, developmental, tissue or environmental regulation of gene transcription as described above. In this example, the 34S promoter (GenBank Accession numbers M59930 and X16673) is used to provide constitutive expression of the trait gene.

After the co-cultivation treatment, the explants are washed and transferred to selection media supplemented with 500 mg/L timentin. Shoots are excised and placed on a shoot elongation medium. Shoots longer than 1 cm are placed on rooting medium for two to four weeks prior to transplanting to soil.

The primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and is used as recommended by the manufacturer.

Example 14c

Engineering Corn Plants by Over-Expressing YNL090W, e.g. from *Saccharomyces cerevisiae* or Plants Transformation of maize (*Zea Mays* L.) is performed with a modification of the method described by Ishida et al. (1996. Nature Biotech 14745-50). Transformation is genotype-dependent in corn and only specific genotypes are amenable to transformation and regeneration. The inbred line A188 (University of Minnesota) or hybrids with A188 as a parent are good sources of donor material for transformation (Fromm et al. 1990 Biotech 8:833-839), but other genotypes can be used successfully as well. Ears are harvested from corn plants at approximately 11 days after pollination (DAP) when the length of immature embryos is about 1 to 1.2 mm. Immature embryos are co-cultivated with *Agrobacterium tumefaciens* that carry "super binary" vectors and transgenic plants are recovered through organogenesis. The super binary vector system of Japan Tobacco is described in WO patents WO94/00977 and WO95/06722. Vectors can be constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673) is used to provide constitutive expression of the trait gene.

Excised embryos are grown on callus induction medium, then maize regeneration medium, containing imidazolinone as a selection agent. The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the imidazolinone herbicides and which are PCR positive for the transgenes.

The T1 generation of single locus insertions of the T-DNA can segregate for the transgene in a 3:1 ratio. Those progeny containing one or two copies of the transgene are tolerant of the imidazolinone herbicide. Homozygous T2 plants can exhibited similar phenotypes as the T1 plants. Hybrid plants (F1 progeny) of homozygous transgenic plants and non-transgenic plants can also exhibited increased similar phenotyps.

Example 14d

Engineering Wheat Plants by Over-Expressing YNL090W, e.g. from *Saccharomyces cerevisiae* or Plants Transformation of wheat is performed with the method described by Ishida et al. (1996 Nature Biotech. 14745-50). The cultivar Bobwhite (available from CYMMIT, Mexico) is commonly used in transformation. Immature embryos are co-cultivated with *Agrobacterium tumefaciens* that carry "super binary" vectors, and transgenic plants are recovered through organogenesis. The super binary vector system of Japan Tobacco is described in WO patents WO94/00977 and WO95/06722. Vectors were constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673) can be used to provide constitutive expression of the trait gene.

After incubation with *Agrobacterium*, the embryos are grown on callus induction medium, then regeneration medium, containing imidazolinone as a selection agent. The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the imidazolinone herbicides and which are PCR positive for the transgenes.

The T1 generation of single locus insertions of the T-DNA can segregate for the transgene in a 3:1 ratio. Those progeny containing one or two copies of the transgene are tolerant of the imidazolinone herbicide. Homozygous T2 plants exhibited similar phenotypes.

Example 14e

Engineering Rapeseed/Canola Plants by Over-Expressing YNL090W, e.g. from *Saccharomyces cerevisiae* or Plants Cotyledonary petioles and hypocotyls of 5-6 day-old young seedlings are used as explants for tissue culture and transformed according to Babic et al. (1998, Plant Cell Rep 17: 183-188). The commercial cultivar Westar (Agriculture Canada) is the standard variety used for transformation, but other varieties can be used.

*Agrobacterium tumefaciens* LBA4404 containing a binary vector are used for canola transformation. Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 57,673,666 and 6,225,105). Similarly, various promoters can be used to regulate the trait gene to provide constitutive, developmental, tissue or environmental regulation of gene transcription. In this example, the 34S promoter (GenBank Accession numbers M59930 and X16673) can be used to provide constitutive expression of the trait gene.

Canola seeds are surface-sterilized in 70% ethanol for 2 min., and then in 30% Clorox with a drop of Tween-20 for 10 min, followed by three rinses with sterilized distilled water. Seeds are then germinated in vitro 5 days on half strength MS medium without hormones, 1% sucrose, 0.7% Phytagar at 23° C., 16 hr. light. The cotyledon petiole explants with the cotyledon attached are excised from the in vitro seedlings, and are inoculated with *Agrobacterium* by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction.

Samples of the primary transgenic plants (T0) are analyzed by PCR to confirm the presence of T-DNA. These results are confirmed by Southern hybridization in which DNA is electrophoresed on a 1% agarose gel and are transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Example 14f

Engineering Alfalfa Plants by Over-Expressing YNL090W Genes, e.g. from *Saccharomyces cerevisiae* or *E. coli* or Plants A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659).

Petiole explants are cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 57,673,666 and 6,225,105). Similarly, various promoters can be used to regulate the trait gene that provides constitutive, developmental, tissue or environmental regulation of gene transcription. In this example, the 34S promoter (GenBank Accession numbers M59930 and X16673) can be used to provide constitutive expression of the trait gene.

The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings are transplanted into pots and grown in a greenhouse.

The T0 transgenic plants are propagated by node cuttings and rooted in Turface growth medium. The plants are defoliated and grown to a height of about 10 cm (approximately 2 weeks after defoliation).

Example 14g

Engineering Alfalfa Plants by Over-Expressing YLR375W Genes, e.g. from *Saccharomyces cerevisiae* or Plants A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659).

Petiole explants are cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 57,673,666 and 6,225,105). Similarly, various promoters can be used to regulate the trait gene that provides constitutive, developmental, tissue or environmental regulation of gene transcription. In this example, the 34S promoter (GenBank Accession numbers M59930 and X16673) can be used to provide constitutive expression of the trait gene.

The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings are transplanted into pots and grown in a greenhouse.

The T0 transgenic plants are propagated by node cuttings and rooted in Turface growth medium. The plants are defoliated and grown to a height of about 10 cm (approximately 2 weeks after defoliation).

Equivalents

Those of ordinary skill in the art will recognize, or will be able to ascertain using no more than routine experimentation, many equivalents to the specific embodiments of the invention described herein. Such equivalents are intended to be encompassed by the claims.

SEQUENCE LISTING (401 sequences)

SEQ ID NO: 1 - DNA, 579 bp, Saccharomyces cerevisiae
  CDS (1)..(579)
atgtctgaaaaggccgttagaaggaaacttgttattattggtgatggtgcttgtggcaagacctctttactatatgtatttacattaggaaaattccctgaacaatatcatccgacagtgttcgagaattatgtcactgattgcagagttgacggaataaaagtgtccttaacgctctgggatacagcgggacaagaggaatatgaacgtttacgtccattctcatattcaaaagcagatataatattaattgggtttgctgtagacaattttgaatcactaattaacgcaaggacgaaatgggcggatgaggcattacgatattgtcctgacgcaccaatcgttcttgtaggcttgaaaaaagatttgaggcaagaagcccattttaaagagaatgctaccgatgaaatggttcccattgaagatgcaaaacaagttgcaagggccattggggccaagaaatacatggaatgtagtgcactgactggtgagggtgtggatgatgtctttgaagtagctacaagaaccagtttgcttatgaagaaggaaccaggggctaactgttgcataattttataa

SEQ ID NO: 2 - protein, 192 aa, Saccharomyces cerevisiae
MSEKAVRRKLVIIGDGACGKTSLLYVFTLGKFPEQYHPTVFENYVTDCRVDGIKVSLTLWDTAGQEEYERLRPFSYSKADIILIGFAVDNFESLINARTKWADEALRYCPDAPIVLVGLKKDLRQEAHFKENATDEMVPIEDAKQVARAIGAKKYMECSALTGEGVDDVFEVATRTSLLMKKEPGANCCIIL

SEQ ID NO: 3 - DNA, 600 bp, Oryza sativa
  CDS (1)..(600)
atgggttgctcctcctccgtgccagctcgaagcactggagggttgaacaatattagcaacgataactccgctactgattcaaaggacttgcgtgctaagttggtattgcttggtgactctggtgtagggaaaagttgcattgttcttcgctttgttcgtggtcagtttgatcccacttccaaggtaactgtcggtgcatcatttttatcacaaacattggctttggaggactcaacaatagtgaaatttgaaatatgggataccgctggacaagagaggtatgctgccttggcacctctttactacagaggagctgctgctgcagttgttgtctacgacataactagtccagaatcatttagcaaagcacaatactgggtgaaggaacttcaaaaacatggtagtcctgatattatcatggttttggttggtaataaagctgatctacatgaaaatcgacatgtatcttctcaggaagcacaagagtatgcagagaagaataatatggttttcatcgagacatcagcaaagacagctgataatataaaccaagtatttgaggaaattgcgaagaggttgcccaggccaacggcgtcttga

SEQ ID NO: 4 - protein, 199 aa, Oryza sativa
MGCSSSVPARSTGGLNNISNDNSATDSKDLRAKLVLLGDSGVGKSCIVLRFVRGQFDPTSKVTVGASFLSQTLALEDSTIVKFEIWDTAGQERYAALAPLYYRGAAAAVVVYDITSPESFSKAQYWVKELQKHGSPDIIMVLVGNKADLHENRHVSSQEAQEYAEKNNMVFIETSAKTADNINQVFEEIAKRLPRPTAS

SEQ ID NO: 5 - DNA, 648 bp, Oryza sativa
  CDS (1)..(648)
atggcgtccagcgcgtcgcggttcatcaagtgcgtcacggtcggggacggcgccgtcggcaagacctgcatgctcatctgctacaccagcaacaagttccccactgattacgtacccactgtttttgacaatttcagtgcaaacgtggtggtcgacggcaccacggtgaatttgggtctctgggatactgcagggcaggaagattacaacagattgaggccgctaagctaccgtggcgccgatgtctttgtgcttgccttctccctagtgagccgagctagctatgagaatgtcatgaagaagtggttaccagagcttcagcattatgcaccaggggtgccaattgtgttggttgggaccaaattggatcttcgtgaagataaacactacttacttgaccatcctagcttggtgcctgtgactacagcacagggagaggaactccgcaagcacattggcgcaacgtgttacatcgaatgcagctcaaagacacagcagaatgtaaaagctgtgtttgatgctgccatcaaggtagtaatcaagcctccaacaaagcagagggacaggaagaagaagaaaacacggcgcggatgttctttcttctgcaagggtgtcatgtccagaagaaggctagtatgcttcaagtga

SEQ ID NO: 6 - protein, 215 aa, Oryza sativa
MASSASRFIKCVTVGDGAVGKTCMLICYTSNKFPTDYVPTVFDNFSANVVVDGTTVNLGLWDTAGQEDYNRLRPLSYRGADVFVLAFSLVSRASYENVMKKWLPELQHYAPGVPIVLVGTKLDLREDKHYLLDHPSLVPVTTAQGEELRKHIGATCYIECSSKTQQNVKAVFDAAIKVVIKPPTKQRDRKKKKTRRGCSFFCKGVMSRRRLVCFK

SEQ ID NO: 7 - DNA, 591 bp, Brassica napus
  CDS (1)..(591)
atgagcgcatcgaggttcataaagtgtgttacagtcggcgatggtgccgtcggaaaaacctgtatgctgatctcttacaccagcaacactttccctacggactatgttccaactgttttcgacaacttcagtgctaacgtggttgttgatgggaacactgtgaatcttggattgtgggatacagctggtcaagaagactataacaggttaagaccattgagttaccgtggtgcagatgtcttcattcttgctttctctcttattagcaaagctagctacgagaacatagccaagaagtggattcctgagctcaggcattatgcccctggagttcctatcattctcgtggggacaaaactcgatcttcgagatgacaagcagttcttcatagaccatcccggtgcagtgccaatcactacaaaccagggagaggaactaaagaaactcataggatctccagtttacattgaatgtagttcaaagacgcagcagaatgtcaaagcagtctttgacgcagctattaaagtggtgcttcagccaccaaaatcaaagaagaagaaaaagaacaagaatcgttgcgttttcttgtga

SEQ ID NO: 8 - protein, 196 aa, Brassica napus
MSASRFIKCVTVGDGAVGKTCMLISYTSNTFPTDYVPTVFDNFSANVVVDGNTVNLGLWDTAGQEDYNRLRPLSYRGADVFILAFSLISKASYENIAKKWIPELRHYAPGVPIILVGTKLDLRDDKQFFIDHPGAVPITTNQGEELKKLIGSPVYIECSSKTQQNVKAVFDAAIKVVLQPPKSKKKKKNKNRCVFL

SEQ ID NO: 9 - DNA, 597 bp, Brassica napus
  CDS (1)..(597)
atgagtgcttcgaggtttatcaagtgtgtcaccgtcggcgacggcgctgtcggaaagacttgtctgctcatctcctacactagcaacactttccccacggactatgtgccaactgtgtttgataatttcagcgcgaatgtgattgtggatgggaacactatcaacttgggattgtgggatactgcagggcaagaggactacaatagactaagaccattgagctatcgcggcgcagatgtcttcttactcgctttctcccttgtcagcaaagctagctatgaaaatgtttctaaaaagtgggtacctgaactgagacattatgctcctggtgttccaatcatcctcgtcggaaccaagcttgatcttcgagatgacaagcaattctttgttgagcaccctggtgctgtgcctatctctactgctcagggtgaagaactgaagaaggtgattggggcacctgcttatattgaatgcagtgcaaaaacacaacagaatgtaaaagcggtgtttgatgcggctatcaaggtagttctccaaccacccaaaaacaagaagaggaagaagagaaagtctcagaaagcttgttctatattgtga

SEQ ID NO: 10 - protein, 198 aa, Brassica napus
MSASRFIKCVTVGDGAVGKTCLLISYTSNTFPTDYVPTVFDNFSANVIVDGNTINLGLWDTAGQEDYNRLRPLSYRGADVFLLAFSLVSKASYENVSKKWVPELRHYAPGVPIILVGTKLDLRDDKQFFVEHPGAVPISTAQGEELKKVIGAPAYIECSAKTQQNVKAVFDAAIKVVLQPPKNKKRKKRKSQKACSIL

SEQ ID NO: 11 - DNA, 591 bp, Glycine max
  CDS (1)..(591)
atgagtacggcaaggtttatcaagtgtgtaacagttggagatggtgctgtgggaaagacatgcatgcttatatcctataccagcaatacctttcccacggattatgttccaacagtgtttgacaatttcagtgctaatgtaacggtggatggtagtactgttaatcttggtttatgggacactgcaggacaagaagattacaacaggctaaggcctttaagctatagaggagctgatgtgtttttgttgtgctattctctcatcagcaaagccagttatgagaacatctccaaaaagtggatacctgagctaagacattatgctccaaatgtgcctatagtgctggtgggaacaaaactagatttgcgagatgacaagcaatttctgattgatcatccgggatccgcacgaataacaactgctcagggtgaagaattgaagaaaatgattggtgcagtcacttatattgagtgcagctccaaaacacagctgaatgtgaagacagtttttgatgctgcaataaaggttgcattgaagccaccaaagccaaagaagaaaccacgcaagaaaaggacctgtactttcctctga

SEQ ID NO: 12 - protein, 196 aa, Glycine max
MSTARFIKCVTVGDGAVGKTCMLISYTSNTFPTDYVPTVFDNFSANVTVDGSTVNLGLWDTAGQEDYNRLRPLSYRGADVFLLCYSLISKASYENISKKWIPELRHYAPNVPIVLVGTKLDLRDDKQFLIDHPGSARITTAQGEELKKMIGAVTYIECSSKTQLNVKTVFDAAIKVALKPPKPKKKPRKKRTCTFL

SEQ ID NO: 13 - DNA, 594 bp, Glycine max
  CDS (1)..(594)
atgagcacaacacggtttattaagtgtgtcacagttggtgatggggctgtgggaaagacttgcatgcttatctcttacactagcaacactttccccacggattatgttcctacagttttcgacaatttcagtgcaaatgttgtggttgatggcagcacagttaacctgggattgtgggacactgctggacaggaagattacaacaggcttaggccattgagttacagaggagcagatgtgttcttgctggccttttccctcatcagcaaagccagctatgaaaatatatctaaaaagtggattcctgaattgagacattatgccccaactgtgcctattgtactggttggaactaaacttgatttgagggaagacaggcaatatttgattgatcatcctggaaccacagctatagctactgcccagggagaagaactgaagaaggcaattggtgctgctgtgtacatagagtgcagctcaaagactcagcagaatgtgaaggccgtgtttgatgctgcaatcaaggttgttttgcaaccacctaagtccaagaaaaaaggaaagaagaagaacacgccttgtgttttcctctga

SEQ ID NO: 14 - protein, 197 aa, Glycine max
MSTTRFIKCVTVGDGAVGKTCMLISYTSNTFPTDYVPTVFDNFSANVVVDGSTVNLGLWDTAGQEDYNRLRPLSYRGADVFLLAFSLISKASYENISKKWIPELRHYAPTVPIVLVGTKLDLREDRQYLIDHPGTTAIATAQGEELKKAIGAAVYIECSSKTQQNVKAVFDAAIKVVLQPPKSKKKGKKKNTPCVFL

SEQ ID NO: 15 - DNA, 591 bp, Glycine max
  CDS (1)..(591)
atgagtgcgtcgaggttcattaagtgcgtcaccgtcggcgacggtgctgtcggcaaaacctgcttgttgatttcctacaccagcaacacttttcccacggactatgtgcccaccgtttttgacaatttcagtgctaatgtggtggtggatggaagcaccgtaaacctaggattgtgggatacagctggtcaggaggattacaatagattaagacccttgagctatcgaggagctgatgtcttcatacttgccttttctctcataagcaaggctagctatgaaaatattgcaaagaagtggatccctgaactaaggcattatgcccctggtgttccaataattctcgttggaacaaagttagatcttcgggatgataagcaattttttatggaccatcctggtgcagtgccaattactacagcacagggagaagaattgagaaagctgattggtgctccggcctacattgagtgtagttccaaaacgcaacagaacgtgaaagctgtctttgacgcggcaatcaaagtggttatccaaccaccaaagctaaagaaaaagagaaaaacacagaaagcttgctccatattatga

SEQ ID NO: 16 - protein, 196 aa, Glycine max
MSASRFIKCVTVGDGAVGKTCLLISYTSNTFPTDYVPTVFDNFSANVVVDGSTVNLGLWDTAGQEDYNRLRPLSYRGADVFILAFSLISKASYENIAKKWIPELRHYAPGVPIILVGTKLDLRDDKQFFMDHPGAVPITTAQGEELRKLIGAPAYIECSSKTQQNVKAVFDAAIKVVIQPPKLKKKRKTQKACSIL

SEQ ID NO: 17 - DNA, 594 bp, Glycine max
  CDS (1)..(594)
atgagcgcttctaggttcatcaagtgcgtcactgttggggatggtgctgtgggcaaaacctgtttgcttatttcctacaccagcaacacttttcccaccgattatgtgccgactgtttttgacaatttcagcgcaaatgtggttgtcaatgggagcattgtgaatctgggtttgtgggatactgctggacaagaggattataacagattaagacctttgagttaccgtggtgccgatgttttcatactggctttctctctcataagcaaggccagttatgaaaatgtctctaaaaagtggattccggagttgaagcattatgctcctggtgtccccattattctggttggcacaaagcttgaccttcgggatgataagcagttctgcattgaccatcctggtgccgtacctattaccacagctcagggagaagagcttaggaagctgattaatgcgccagcttacattgaatgcagttcaaaaacacaggagaacgtgaaggcagtctttgatgcagccataagagttgtccttcaaccacctaagcagaagaaaaagaagggtaaagcacaaaaggcctgttcgatattgtga

SEQ ID NO: 18 - protein, 197 aa, Glycine max
MSASRFIKCVTVGDGAVGKTCLLISYTSNTFPTDYVPTVFDNFSANVVVNGSIVNLGLWDTAGQEDYNRLRPLSYRGADVFILAFSLISKASYENVSKKWIPELKHYAPGVPIILVGTKLDLRDDKQFCIDHPGAVPITTAQGEELRKLINAPAYIECSSKTQENVKAVFDAAIRVVLQPPKQKKKKGKAQKACSIL

SEQ ID NO: 19 - DNA, 594 bp, Glycine max
  CDS (1)..(594)
atgagtgcgtccaggttcatcaagtgtgtcactgtgggtgacggtgccgttggcaagacttgcatgctcatctcctacaccagcaacacttttcctacggactacgtgccaactgtctttgacaatttcagtgcaaatgtcgttgtggatggaagcactgtgaatcttgggttgtgggatactgctggccaagaagattacaatagattgagacccttaagctatcgtggagcagatgtattcctgcttgctttctctctcataagcagggccagctatgaaaatgttgccaagaaatggattcctgagttgaggcattatgctcctggtgttccaattattcttgttggaacaaaacttgatcttcgggatgataagcagttctttcaagaccatcctggtgcagtgcctatcaccacagcacagggtgaggaactgagaaagcttatcggtgctccaatttacattgaatgtagttcaaaaacacaacagaatgtgaaggctgtttttgatgcagccatcaaggtagttctccagcccccaaagcagaagaaaaagaagagaaagggacaaaaggcctgttccattttgtga

SEQ ID NO: 20 - protein, 197 aa, Glycine max
MSASRFIKCVTVGDGAVGKTCMLISYTSNTFPTDYVPTVFDNFSANVVVDGSTVNLGLWDTAGQEDYNRLRPLSYRGADVFLLAFSLISRASYENVAKKWIPELRHYAPGVPIILVGTKLDLRDDKQFFQDHPGAVPITTAQGEELRKLIGAPIYIECSSKTQQNVKAVFDAAIKVVLQPPKQKKKKRKGQKACSIL

SEQ ID NO: 21 - DNA, 594 bp, Glycine max; identical to SEQ ID NO: 19
  CDS (1)..(594)

SEQ ID NO: 22 - protein, 197 aa, Glycine max; identical to SEQ ID NO: 20

SEQ ID NO: 23 - DNA, 639 bp, Glycine max
  CDS (1)..(639)
atggcttccgcaactgccccaagattcatcaagtgcgtgaccgttggtgatggagctgtagggaagacctgcatgctcatttgctataccagcaacaaattccccacggactatatccccactgtgtttgataatttcagtgcaaatgtggttgttgaaggcataactgtcaacttaggcctttgggatacagctgggcaagaggattacaacaggctgaggcccttgagctacaggggggcagatgtctttgtcttggctttttctttagttagtcgcgcgagctatgagaatgtgctgaagaagtggatccctgaactccagcattttgcccctggcatcccgttggtgttagttggcaccaaattggatctacgagaagacaagcactacatggctgatcatcccagcttggtgccagtgactactgatcaaggtgaggaactccgtaaacacattggagctacctactatattgagtgcagctcaaaaactcagcagaatgtgaaggcagtttttgatgctgctattagaatggtcatcaagcctccacaaaagcaaaacgagaaaagaaagaaaaaaccacgtggctgtttcctaaacgtcctctgtcgaaggaacattgttcgccttaaatga

SEQ ID NO: 24 - protein, 212 aa, Glycine max
MASATAPRFIKCVTVGDGAVGKTCMLICYTSNKFPTDYIPTVFDNFSANVVVEGITVNLGLWDTAGQEDYNRLRPLSYRGADVFVLAFSLVSRASYENVLKKWIPELQHFAPGIPLVLVGTKLDLREDKHYMADHPSLVPVTTDQGEELRKHIGATYYIECSSKTQQNVKAVFDAAIRMVIKPPQKQNEKRKKKPRGCFLNVLCRRNIVRLK

SEQ ID NO: 25 - DNA, 762 bp, Brassica napus
  CDS (1)..(762)
atggttggaccaggaagacctcaaatcgtcctcttcggttcatcaatcgttcaatacagcttcagcgatggtggatggggagccactctcgctaacatctactctcgcacggctgacgtaatccttcgtgggtatgctggttggaactccagatctgccttgaaggtgttaaaccaagtgttcccaaaggatgctgttatacaaccttctttggtgatagtctatttcggagggaatgattcaatgcctcctcatccatcagggcaaggacctcatgttcctctctctgaattcactgagaacatgaggaagatcggagagcatcttttgagcctctcggacaagacccgtgtcatttttctcactcccccaccaatgaacgagagacaaatccaactagtgtttggagatgcaatgagaggccggagtaacgagctgtgtcgtccatacgcagaagcgttgttgaatctatgcagagagatcaatgtgaaaggtatcgatctttggaacgcaatacagcaacaagatgattggttacacacttgcttcactgacggtatccatttcacggccaaggcgagcgagattgtggtgaaggagatattgaaagtagtgagagaagctgattggaaaccgagtcttgacaggaagtcattaccggttgagtttccatttgattctggtctaccaaactccccaagacatagtgatctagaattaactagaaacaagaagttggagcctcgtatggcccgattgtaa

SEQ ID NO: 26 - protein, 253 aa, Brassica napus
MVGPGRPQIVLFGSSIVQYSFSDGGWGATLANIYSRTADVILRGYAGWNSRSALKVLNQVFPKDAVIQPSLVIVYFGGNDSMPPHPSGQGPHVPLSEFTENMRKIGEHLLSLSDKTRVIFLTPPPMNERQIQLVFGDAMRGRSNELCRPYAEALLNLCREINVKGIDLWNAIQQQDDWLHTCFTDGIHFTAKASEIVVKEILKVVREADWKPSLDRKSLPVEFPFDSGLPNSPRHSDLELTRNKKLEPRMARL

SEQ ID NO: 27 - DNA, 651 bp, Brassica napus
  CDS (1)..(261)
atggcttcaactgcttcaaagttcataaaatgtgtgactgttggtgatggcgccgtaggtaaaacctgtatgctcatctgctacaccagcaacaaattccctactgactacataccaacagtttttgacaactttagtgcaaacgttgtagttgaaggcaccactgtgaacctaggcctatgggacactgctgggcaagaagactacaacagattaaggcctttaagttacagaggagcagatgttttcgtcctgtctttctccttggtcagccgagctagctacgagaatgtttataaaaagtggatccctgaactccaacactttgccccaggagttccattagtccttgttggtaccaaactagatctccgtgaagataataagcattatttggctgaccatcctggactatcccctgtaactactgcacagggagaggaattgcgtaagctaatcggtgcgacatattacattgaatgtagctcgaaaactcaacagaatgtgaaagcagtttttgattcagcgatcaaggaagtgatcaaaccggtggttaaacaaaaggagaagacgcagaaaacgaagaagcaaaagtctaatcatggctgtttatcaaacgttctgtgtgggaggatagtgactcggcattga

SEQ ID NO: 28 - protein, 87 aa, Brassica napus
MASTASKFIKCVTVGDGAVGKTCMLICYTSNKFPTDYIPTVFDNFSANVVVEGTTVNLGLWDTAGQEDYNRLRPLSYRGADVFVLSF

SEQ ID NO: 29 - DNA, 651 bp, Brassica napus
  CDS (1)..(651)
atggcttcaagtgcttcaaagttcatcaaatgtgtaactgttggtgatggtgccgttggtaaaacctgtatgctcatctgctataccagcaacaagttccctactgactatgtaccaacggtttttgacaactttagtgcaaacgttgtagttgaaggaactactgtgaacttagggctatgggatactgctggacaagaagactataacagattaaggcctttaagctacagaggagcagatgtcttcgtcttgtctttctcattggttagccgagctagctacgagaatgtttttaaaaagtggatccctgaactccaacactttgctccaggagttccattagttcttgtcggtaccaaattagatctccgtgaggataagcattatctggctgaccatcctggactatcccctgtaactactgcacagggagaggagttgcgtaagctcattggtgcaacatattacattgaatgtagctcaaaaactcaacagaatgtcaaagcagtttttgattcggcaatcaaggaagtgatcaaaccggtgcttaaacagaagggcaagaccaagaaaaagaagaagcaacagtcgaatcaccacgggtgtttatcaaacgttttgtgtgggaggatagtgacccggcattga

SEQ ID NO: 30 - protein, 216 aa, Brassica napus
MASSASKFIKCVTVGDGAVGKTCMLICYTSNKFPTDYVPTVFDNFSANVVVEGTTVNLGLWDTAGQEDYNRLRPLSYRGADVFVLSFSLVSRASYENVFKKWIPELQHFAPGVPLVLVGTKLDLREDKHYLADHPGLSPVTTAQGEELRKLIGATYYIECSSKTQQNVKAVFDSAIKEVIKPVLKQKGKTKKKKKQQSNHHGCLSNVLCGRIVTRH

SEQ ID NO: 31 - DNA, 606 bp, Brassica napus
  CDS (1)..(606)
atgagcacagcgagattcatcaagtgtgtgacggtcggagatggagctgtggggaagacttgtatgctgatttcatataccagcaatacttttcctacggattacgttccgacagtttttgacaatttcagtgcgaatgtggtggtcgatggaagtactgtcaacctcggcctgtgggatactgctgggcaggaagattataacaggcttcggcctttgagttacagaggagcagatgtgtttttattggcattttccctaattagcaaggccagttacgagaacatttacaaaaagtggcttccggagctgaaacattatgcgcctagcatccccattgtactcgtcggaaccaagttagatttgagggatgacaaacagttcttgaaagatcatccaggagcagcttcaataacaactgcccagggagaggaattaagaaagatgattggagccatcaagtacttagaatgcagctccaaaacccagcagaatgtgaaggcagtgtttgatacagcgatccgggtagcgttgaggcctccaaaggcaaagaagaagataaagccattgaggaccaaaagatcaagaacatgctttttcttctaa

SEQ ID NO: 32 - protein, 201 aa, Brassica napus
MSTARFIKCVTVGDGAVGKTCMLISYTSNTFPTDYVPTVFDNFSANVVVDGSTVNLGLWDTAGQEDYNRLRPLSYRGADVFLLAFSLISKASYENIYKKWLPELKHYAPSIPIVLVGTKLDLRDDKQFLKDHPGAASITTAQGEELRKMIGAIKYLECSSKTQQNVKAVFDTAIRVALRPPKAKKKIKPLRTKRSRTCFFF

SEQ ID NO: 33 - DNA, 636 bp, Brassica napus
  CDS (1)..(636)
atgtcagcttcagtggctgctgcatcagtatcaacaacaacaacagcagctacaacgtttatcaagtgcgtcactgttggcgatggagctgtgggcaaaacttgtcttcttatctcctacaccagcaacacctttcctactgattatgttcctacagtgttcgacaacttcagtgcaaatgttctagtcgatggcaaaaccgtcaatcttggtctttgggatactgctggtcaagaagattacaataggcttagaccattgagttacagaggagcagatgttttcattcttgccttttctcttatcagcaggcctagctttgagaacattgctaaaaagtgggtccctgagctgcgacattatgcccctaacgtgcctattgttctagtgggaactaaattagatctaagagaggataagaagttcccaatgaactatccaggtgcttgcacaatctcaacagaacaaggtcaagagctaagaaaagagataggagcattagcatatatagagtgcagctcaaaaacacaacagaacgtgaaagcggtgtttgatgcagcgataaaagtagttctacagcctcctacaaaaattaagaaacaaaagagaagatttcgtttctgccatgctctctga

SEQ ID NO: 34 - protein, 211 aa, Brassica napus
MSASVAAASVSTTTTAATTFIKCVTVGDGAVGKTCLLISYTSNTFPTDYVPTVFDNFSANVLVDGKTVNLGLWDTAGQEDYNRLRPLSYRGADVFILAFSLISRPSFENIAKKWVPELRHYAPNVPIVLVGTKLDLREDKKFPMNYPGACTISTEQGQELRKEIGALAYIECSSKTQQNVKAVFDAAIKVVLQPPTKIKKQKRRFRFCHAL

SEQ ID NO: 35 - DNA, 588 bp, Brassica napus
  CDS (1)..(588)
atgagcgcttcgaggttcataaagtgtgtcaccgtcggcgatggtgccgtcggaaaaacctgtatgctgatctcttacacgagcaacaccttccctacggactatgtaccaactgttttcgataacttcagtgctaatgtggttgttgatgggaacactgtgaatcttggcttgtgggatacagctggtcaagaagactataacaggttaagaccattgagttaccgtggtgcggatgtcttcattcttgctttctctcttatcagcaaagctagctacgagaatatagctaagaagtggattcctgagctcaggcactatgcccctggtgttcctattatcctcgttggaacaaaactcgatcttcgagatgacaagcagttcttcatagaccaccctggtgcagtgccgattagtactaaccagggagaggaactaaagaaactgatagggtctccggcttacattgaatgcagttcaaagacgcagcagaacgtgaaggcagtctttgacgcagccataaaagtagtgcttcagccaccaaagcaaaagaagaagaaaaagaagaatggttgtgttttcttgtga

SEQ ID NO: 36 - protein, 195 aa, Brassica napus
MSASRFIKCVTVGDGAVGKTCMLISYTSNTFPTDYVPTVFDNFSANVVVDGNTVNLGLWDTAGQEDYNRLRPLSYRGADVFILAFSLISKASYENIAKKWIPELRHYAPGVPIILVGTKLDLRDDKQFFIDHPGAVPISTNQGEELKKLIGSPAYIECSSKTQQNVKAVFDAAIKVVLQPPKQKKKKKKNGCVFL

SEQ ID NO: 37 - DNA, 594 bp, Brassica napus
  CDS (1)..(594)
atgagcgcatcgaggttcataaagtgtgtgaccgttggtgacggagctgtgggtaaaacatgtctcctcatttcttacaccagcaacactttccctacggattatgttccgactgtttttgataacttcagcgctaatgtggttgttaacggagccactgtcaaccttggcttgtgggataccgctgggcaggaggattataacaggttaagaccattgagttaccgcggtgctgatgttttcatcttagccttctccctcatcagtaaggctagttatgagaatgtctccaagaagtggatccctgagctgactcactatgcccctggtgtcccaattgttcttgttggtaccaaactagatcttagggatgacaaacagttcttcgttgaccaccctggtgctgtacctattaccactgctcagggagaggaactgatgaagctaattggagctccttcgtacatcgagtgcagttcaaaatcacaggagaacgtgaagggggtgtttgatgcagcgattagagtggtacttcaacctccaaagcagaagaaaaagaagggcaaagtacaaaaggcctgctccattttgtaa

SEQ ID NO: 38 - protein, 197 aa, Brassica napus
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELTHYAPGVPIVLVGTKLDLRDDKQFFVDHPGAVPITTAQGEELMKLIGAPSYIECSSKSQENVKGVFDAAIRVVLQPPKQKKKKGKVQKACSIL

SEQ ID NO: 39 - DNA, 645 bp, Oryza sativa
  CDS (1)..(645)
atgagctcggcggcggcggcgacgaggttcatcaagtgcgtcaccgtgggggacggcgcggtggggaagacgtgcatgctcatctgctacacctgcaacaagttccccaccgattacatccccaccgtgttcgacaacttcagcgccaatgtctccgtggacgggagcgtcgtcaacctcggcctctgggacactgcaggtcaggaggattacagcaggttgaggcctctgagctacaggggagccgatgtgttcatcctgtccttctccctgataagcagggcgagctatgagaatgttcagaagaagtggatgccagagcttcgccggtttgcgcctggtgttcctgtagttcttgttggaaccaagttggatctccgtgaagatagggcctatcttgctgatcatccagcttcttccataataacaacggagcagggagaagaactgaggaagctaataggagcggtcgcctacatcgaatgcagctccaagacacagagaaacattaaagctgttttcgacactgccatcaaagtggtgcttcaacctccaagacataaggatgtaaccagaaagaaactccaatcaagctccaatcggccagtaaggcggtacttttgcggaagcgcttgtttcgcgtag

SEQ ID NO: 40 - protein, 214 aa, Oryza sativa
MSSAAAATRFIKCVTVGDGAVGKTCMLICYTCNKFPTDYIPTVFDNFSANVSVDGSVVNLGLWDTAGQEDYSRLRPLSYRGADVFILSFSLISRASYENVQKKWMPELRRFAPGVPVVLVGTKLDLREDRAYLADHPASSIITTEQGEELRKLIGAVAYIECSSKTQRNIKAVFDTAIKVVLQPPRHKDVTRKKLQSSSNRPVRRYFCGSACFA

SEQ ID NO: 41 - DNA, 645 bp, Oryza sativa
  CDS (1)..(645)
atgagcggcgccaccaagttcatcaagtgcgtcaccgtcggcgacggcgccgtcggcaagacctgcatgctcatctgctacatcagcaacaagttccccaccgattacatccccaccgtgttcgacaacttcagtgctaatgtttcagtggatgggaacatcgtcaacttgggattatgggacactgctggacaagaggattacagcaggctgaggccactgagctacaggggagcggatatatttgtgctggcattctcactgatcagcagagcaagctatgagaatgttctcaagaagtggatgccggagcttcgccggttcgcaccgaatgttccaattgttcttgttgggaccaagttagatctacgtgaccacagatcttaccttgcggaccatcctgctgcttccgcaattacgactgcacagggtgaagaacttagaaagcagataggcgccgcggcttacatcgaatgcagttcgaaaacacaacagaacatcaaggccgtgtttgatactgccatcaaggtggtccttcagcctcctcggagaaggggggagacgacgatggcaaggaagaagacaaggcgaagcaccggctgctcgttaaagaacttgatgtgtggcagtgcatgtgttgtttag

SEQ ID NO: 42 - protein, 214 aa, Oryza sativa
MSGATKFIKCVTVGDGAVGKTCMLICYISNKFPTDYIPTVFDNFSANVSVDGNIVNLGLWDTAGQEDYSRLRPLSYRGADIFVLAFSLISRASYENVLKKWMPELRRFAPNVPIVLVGTKLDLRDHRSYLADHPAASAITTAQGEELRKQIGAAAYIECSSKTQQNIKAVFDTAIKVVLQPPRRRGETTMARKKTRRSTGCSLKNLMCGSACVV

SEQ ID NO: 43 - DNA, 639 bp, Oryza sativa
  CDS (1)..(639)
atgggctcgaagccgccgccgccgccgcagcccagcgtctccttcaagctcgtcctcctcggcgacgggagagtaggcaaaacatctcttgtgctgcggtatgtgaatgatgtcttctcagacaaacaggaagcaactgttcaagcttcatatttgacaaagcgccttgttgttgaaggtgtgcctattacgctctctatctgggatacagctggacaagagaagttccatgcactaggccctatatactatcgtgatgcagacgctgctcttttagtatatgacatcacagacaatgatacttttcttcgtgtcacaaagtgggtgaaagagcttaagcaaatggcaaataaagatattgttatggccattgcagcaaataaaagtgacctggttagatcaaaacacatagacactaatgaagcagcaagctatgcagaaagtattggggcaactctctttgttacttctgccaaagctggtactgggattgatgatatcttcagtgacatagccaagagattattagagagaagaaaaaacagctccgatggcttgtcactggctcatccaaagaaaggcattttaatcgtcgacgatgaacctgagaaagaacctccaccaaagtgctgctcatag

SEQ ID NO: 44 - protein, 212 aa, Oryza sativa
MGSKPPPPPQPSVSFKLVLLGDGRVGKTSLVLRYVNDVFSDKQEATVQASYLTKRLVVEGVPITLSIWDTAGQEKFHALGPIYYRDADAALLVYDITDNDTFLRVTKWVKELKQMANKDIVMAIAANKSDLVRSKHIDTNEAASYAESIGATLFVTSAKAGTGIDDIFSDIAKRLLERRKNSSDGLSLAHPKKGILIVDDEPEKEPPPKCCS

SEQ ID NO: 45 - DNA, 806 bp, Brassica napus
  CDS (6)..(596)
ggaaaatgagcgcatctcggttcataaagtgcgtgacggtcggtgacggagcagtgggcaaaacatgtctcctcatctcttacaccagcaacactttccctacggattatgtgcccactgttttcgataactttagcgctaacgttgttgttaacggagccactgtcaacttaggactctgggatacagcagggcaggaggattataacagattgagacccttgagttaccgcggtgctgacgttttcatcttagccttctctcttatcagtaaggctagttatgagaatgtctccaagaagtggatccctgagctgacccactatgcccctggtgtccctattgttcttgttggaaccaaactagatcttagggatgacaaacagttcttcgttgaccaccctggtgctgtacctattaccactgctcagggcgaggaactaatgaagctaattggagctccttcgtacatcgagtgcagctcaaaatcacaggagaacgtgaagggggtgtttgatgcagcgatcagagtggtacttcaacctccaaagcagaagaaaaagaagagcaaagctcaaaaggcctgctccattttgtgatttctctacgctcatctctcttccactctctagtgaaggcttaagaagaagaaacactttagcctttaagatttggttcagagttcgttgtgataagcctcgcttaatccttagaaacgattacttctggttttactgataaagagcttccagctttatagctgagagctaatattgcactaccactataaaaaaaaaaaaaaaaaa

SEQ ID NO: 46 - protein, 197 aa, Brassica napus
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELTHYAPGVPIVLVGTKLDLRDDKQFFVDHPGAVPITTAQGEELMKLIGAPSYIECSSKSQENVKGVFDAAIRVVLQPPKQKKKKSKAQKACSIL

SEQ ID NO: 47 - protein, 32 aa, unknown
  MISC_FEATURE (15)..(15): Xaa is Leu, Ile or Met
  MISC_FEATURE (16)..(16): Xaa is Leu or Val
  MISC_FEATURE (17)..(17): Xaa is Ile, Leu or Tyr
  MISC_FEATURE (18)..(18): Xaa is Ser, Cys, Val or Arg
  MISC_FEATURE (20)..(20): Xaa is Thr, Ile or Val
  MISC_FEATURE (23)..(23): Xaa is Thr, Lys, Gln or Val
  MISC_FEATURE (1)..(32): consensus
KCVTVGDGAVGKTCXXXXYXSNXFPTDYVPTV

SEQ ID NO: 48 - protein, 32 aa, unknown
  MISC_FEATURE (1)..(32): Xaa is any natural amino acid
  MISC_FEATURE (1)..(32): consensus
KXVXXGDXXXGKXXXXXXXXXXXFXXXXXXTV

SEQ ID NO: 49 - protein, 16 aa, unknown
  MISC_FEATURE (1)..(16): consensus
LWDTAGQEDYNRLRPL

SEQ ID NO: 50 - protein, 16 aa, unknown
  MISC_FEATURE (1)..(1): Xaa is Leu or Ile
  MISC_FEATURE (9)..(9): Xaa is Asp, Lys or Glu
  MISC_FEATURE (10)..(10): Xaa is Tyr or Phe
  MISC_FEATURE (11)..(11): Xaa is Asn, Ser, Ala, His or Glu
  MISC_FEATURE (12)..(12): Xaa is Arg or Ala
  MISC_FEATURE (14)..(14): Xaa is Arg, Ala or Gly
  MISC_FEATURE (16)..(16): Xaa is Leu, Ile or Phe
  MISC_FEATURE (1)..(16): consensus
XWDTAGQEXXXXLXPX

SEQ ID NO: 51 - protein, 7 aa, unknown
  MISC_FEATURE (1)..(7): consensus
GTKLDLR

SEQ ID NO: 52 - protein, 7 aa, unknown
  MISC_FEATURE (1)..(1): Xaa is Gly or Ala
  MISC_FEATURE (2)..(2): Xaa is Thr, Asn or Leu
  MISC_FEATURE (4)..(4): Xaa is Leu, Ala, Ser or Lys
  MISC_FEATURE (7)..(7): Xaa is Arg, His or Val
  MISC_FEATURE (1)..(7): consensus
XXKXDLX

SEQ ID NO: 53 - DNA, 24 bp, unknown
  MISC_FEATURE (1)..(24): primer
atgtctgaaaaggccgttagaagg

SEQ ID NO: 54 - DNA, 26 bp, unknown
  MISC_FEATURE (1)..(26): primer
ttataaaattatgcaacagttagccc

SEQ ID NO: 55 - DNA, 579 bp, Saccharomyces cerevisiae; identical to SEQ ID NO: 1
  CDS (1)..(579)

SEQ ID NO: 56 - protein, 192 aa, Saccharomyces cerevisiae; identical to SEQ ID NO: 2

SEQ ID NO: 57 - DNA, 803 bp, Nicotiana tabacum
  CDS (49)..(642)
aaaaaaaaaaaaaaaaaaaaaaaaaaaaaaaaaagaaaaaagaaaaaaatgagtgcttcaaggtttatcaagtgtgttacggttggtgatggtgctgttgggaaaacttgtcttttgatttcatacaccagcaatactttccctacggattatgtgcccactgtgtttgacaatttcagtgcaaatgttgttgtcaatgggagcactgtcaacctagggttgtgggatactgctggacaggaggattacaataggttaagacctctgagttaccgtggagccgatgttttcattttggcattctctctcattagtaaagccagctatgagaatgtttccaagaagtggattcctgagttgaagcactatgctcctggtgtcccaatagttcttgttggaacaaagcttgatcttcgggatgataagcaattcttcatagaccatcccggtgctgtgccaattactactgctcagggcgaggagctaaggaaaactattggtgcacctgcttacattgaatgtagttcaaaaacacaacagaatgtgaaagcagtctttgatgctgccattaaggtcgtcctccagccgcctaagacgaagaaaaagaaggggaaatctcaaaaatcctgctcgatattgtgatcaaactgtaggtccaacgatagtgctggtcacaattctcgttgtaatccctcactcactcgtatccctttatcttccttcgtctcagaggaagtacgaggtcatcgtttgtcttatatttgaaactactaaccatctcttggaaatatcaggtggcttgg

SEQ ID NO: 58 - protein, 197 aa, Nicotiana tabacum
MSASRFIKCVTVGDGAVGKTCLLISYTSNTFPTDYVPTVFDNFSANVVVNGSTVNLGLWDTAGQEDYNRLRPLSYRGADVFILAFSLISKASYENVSKKWIPELKHYAPGVPIVLVGTKLDLRDDKQFFIDHPGAVPITTAQGEELRKTIGAPAYIECSSKTQQNVKAVFDAAIKVVLQPPKTKKKKGKSQKSCSIL

SEQ ID NO: 59 - DNA, 993 bp, Nicotiana tabacum
  CDS (29)..(625)
ggcacgagggagatttgggttttgtagaatgagtgcgtctaggttcataaagtgtgtcaccgttggcgacggagctgtgggtaaaacttgtcttctcatttcctataccagcaacacatttcccactgattacgtcccaactgtattcgacaattttagtgcaaatgtggttgtcgatgggagcactgtcaatctggggctgtgggatactgcaggtcaggaggattacaatagattaagaccgttgagctaccggggggcagatgtatttatactggcattttctctcattagcaaagcgagctatgaaaatgtctccaaaaagtggattcctgaattgaggcattatgctcctggagttccaattattcttgttggaacaaagctagatctccgagaggataagcaattcttcctggaccatccaggtgctgttccacttaccacagctcagggtgaagagctgagaaagtcgattggtgcttccgcttacattgaatgtagtgcaaaaacacaacagaatgtgaaggctgtttttgatgctgccattaaggtggttctacaaccacccaaacaaaagaagaaaaagaagagaaagggtcaaaaagcctgctctatcttgtgattgctgaaataatagacaagtgatggagatgtagattgttatcaatgtcttccaagttcaaagaatgcagtgtaaggttcaacgttggtagtcctgactgactatgataggaaagcatgaatctgccttgtccgtaacattggaggccaagatgtatatttgtgatccgcatatggttggggatacagatgtgcaaaattctctgtttcgcgttgattctgtgtaatatattatgtaacacttgtgtgatgattccttgaatttgcatctactatgtgttgttaaaatgtaaccgaacatactgatttagattgtccaagaagttgaatttgctatgtcataaaaaaaaaaaaaaaaaaaaaaaaaaa

SEQ ID NO: 60 - protein, 198 aa, Nicotiana tabacum
MSASRFIKCVTVGDGAVGKTCLLISYTSNTFPTDYVPTVFDNFSANVVVDGSTVNLGLWDTAGQEDYNRLRPLSYRGADVFILAFSLISKASYENVSKKWIPELRHYAPGVPIILVGTKLDLREDKQFFLDHPGAVPLTTAQGEELRKSIGASAYIECSAKTQQNVKAVFDAAIKVVLQPPKQKKKKKRKGQKACSIL

SEQ ID NO: 61 - DNA, 640 bp, Gossypium hirsutum
  CDS (17)..(613)
cacgcgtggcgtaagtatgagtgcttccaggttcataaaatgcgtcacggtcggtgacggtgccgtcggcaagacttgtctgctcatttcctacactagcaatactttccctaccgattatgtgccaactgtctttgacaactttagtgctaatgtggttgtggatgggaacactgttaatctgggattgtgggatactgctggacaggaagattacaatagattaagaccattgagctatcgtggagcagatgtcttcttgctggcattttctctcattagcaaagctagctatgaaaatgttgctaagaaatggattccagaattgagacattatgcacccggtgttccaattattcttgttgggactaagcttgatcttcgagaagataagcagttcttcatagatcaccctggtgcggtgcccattaccacagcacagggtgaggaattgagaaagctaattggagcgcatttttacattgagtgtagttcaaaaacacaacagaatgtgaaagcggtctttgatgcggccatcaaagtagttctccagcctccaaagaagaagaagaaaaagaagagaaaggcacaaaaagcttgctcaatattgtgatcatgcaaagaagtgatattggtgcag

SEQ ID NO: 62 - protein, 198 aa, Gossypium hirsutum
MSASRFIKCVTVGDGAVGKTCLLISYTSNTFPTDYVPTVFDNFSANVVVDGNTVNLGLWDTAGQEDYNRLRPLSYRGADVFLLAFSLISKASYENVAKKWIPELRHYAPGVPIILVGTKLDLREDKQFFIDHPGAVPITTAQGEELRKLIGAHFYIECSSKTQQNVKAVFDAAIKVVLQPPKKKKKKKRKAQKACSIL

SEQ ID NO: 63 - DNA, 1025 bp, Nicotiana tabacum
  CDS (103)..(696)
ttcttgtatccgcccagctcccccatacccatttcaatctttttttttgtttataatttttttctgggaatcaggtcttctcaagaagatctgagaagaaaaatgagtgcttcgaggtttataaaatgtgtgacggtgggtgatggtgccgttggaaaaacgtgtctcttgatttcttacaccagcaacacctttcctacggattatgtgcctactgtgttcgataatttcagtgcaaatgtggtcgtcaatgggagtactgtcaacctagggttgtgggatacagctggacaggaggattacaataggttaagacctctgagttaccgtggagctgatgttttcatcttggcattctctctcattagtaaagccagctatgaaaatgtttccaagaagtggattcctgagttgaagcattatgctcccggtgttccaatagtgcttgttggaacaaaacttgatcttcgggatgataagcagttcttcatagaccatcctggtgctgtgccaattactactgctcagggcgaggagctgaggaaaacgattggggcccctgcttacattgaatgtagttcaaaaacacaacagaatgtgaaagcagtctttgatgctgctattaaggtcgtgctccagccacccaagcagaaaaaaaagaaggggaaggcccaaaaggcatgttcgattttgtgatcaacagtaggtccaacaatattactggtcacagttctccttgtaatctctccctcatattcctttgtttttcctttgtctcggagaaagtaggaggtccatgtatgtctctttaaaattacttgtgatctcttgaattgcaggtggctcggtttttatactgctgtcatctctagttgttgagtcacagcaccttgttgtaggccactgattgggccctctctggtttcatttgctttatgattaatgactgaaagatccagttggaaaaaaaaaaaaaaaaaaaaaaaaaactcggggggggccgggcccaatcccctataggggtg

SEQ ID NO: 64 - protein, 197 aa, Nicotiana tabacum
MSASRFIKCVTVGDGAVGKTCLLISYTSNTFPTDYVPTVFDNFSANVVVNGSTVNLGLWDTAGQEDYNRLRPLSYRGADVFILAFSLISKASYENVSKKWIPELKHYAPGVPIVLVGTKLDLRDDKQFFIDHPGAVPITTAQGEELRKTIGAPAYIECSSKTQQNVKAVFDAAIKVVLQPPKQKKKKGKAQKACSIL

SEQ ID NO: 65 - DNA, 1178 bp, Medicago truncatula
  CDS (136)..(729)
cctatttcatcttcatcaccgattattcttgaacagttaccaatttcaaactcaaacacacaacaacattgacacatgaataattagggtttatacctcaaagaaacacaacaaacttgaataattaggttcgaaatgagtggttccaggttcatcaagtgtgtcacagttggtgatggtgccgttggaaagacttgtttgcttatctcctacaccagcaacactttccctacggactatgtgccgactgtctttgacaatttcagtgcaaatgtagttgtggatgggagcactataaatctcgggttgtgggatactgctggccaagaagattacaatagattaagacccttaagctatcgtggagcagatgttttcctgcttgctttttctctcataagcaaggctagctatgaaaatattgccaaaaaatggattcctgagttgaggcattatgctcctggtgttccaattattctcgttggaacaaaacttgatcttcgggatgatagccagttctttcaagaccatcctggtgcggcgccaatcaccacagcacagggtgaggaactgagaaaacttatcggtgctccagtttacattgaatgtagttccaaaacacagaagaatgtgaaggctgtttttgattcggccatcaaagtagttctacagccaccaaagcaaaagaaaacaaagagaaaggggcaaaaagcctgttccattttgtgatcttcagttctttcgtattgtagtttgtggaggatgacatgacagtagccattttcctgggtaatcctttgccattctgattctatatatatccttatactattttcgacctagatggaggaaccgccatgtccaactgaccgcgttaaagcttgcttataaaaaatcaagctatttgtctctggctgaaggataatatgtgaagtcataattccatcatgtttggtgtgtacaattgttgtgtttctccggaatgtttaccttttgtattgattatcaaatggtcatctccatttgtggacatgggttttactcacattgtagtctaatcttaggaagtgcttgcaacatatgtgctttggatgtgaactaagtatatgtaattaattatgttagctacttaacatccttaatatagctcggtttgttcaaaaaaaaaaaaaaaaaaa

SEQ ID NO: 66 - protein, 197 aa, Medicago truncatula
MSGSRFIKCVTVGDGAVGKTCLLISYTSNTFPTDYVPTVFDNFSANVVVDGSTINLGLWDTAGQEDYNRLRPLSYRGADVFLLAFSLISKASYENIAKKWIPELRHYAPGVPIILVGTKLDLRDDSQFFQDHPGAAPITTAQGEELRKLIGAPVYIECSSKTQKNVKAVFDSAIKVVLQPPKQKKTKRKGQKACSIL

SEQ ID NO: 67 - DNA, 1139 bp, Medicago truncatula
  CDS (174)..(767)
acgaacgaacgcttcaacggcaaaatttcccgggttccttgtctctctttcatgcgcgagaattctcattttctcacgctcctaatggatgcgtaattgaagcgaataattggaggagtgtgtgagtgatttggagtaataaggtgaaagatctggatagggtttgaaagaagatgagcgcttctaggttcatcaagtgtgttactgttggggatggagctgttggtaaaacttgtttgttaatttcatacaccagcaataccttccccactgactatgtgccaactgtcttcgacaatttcagtgcaaatgtggttgtgaatggaagcactgtgaatctgggtttgtgggacactgcaggacaagaggattataacagattaagacctttgagttatcgtggtgccgatgttttcattctcgctttctccctcataagcaaggccagttatgaaaatgtttccaaaaagtggattccagagttgaagcattatgcacctggtgttcccattattctggttggcacaaagcttgaccttcgggatgacaagcagttcttcgtcgaccatcctggtgctgttcctattaccactgctcagggagaagagcttaggaagctgatcaatgcacctgcttatatcgaatgcagttcgaaatcacagcagaatgtgaaagcagtctttgatgcagccataagagttgtccttcaaccaccaaagcaaaagaaaaagaagagtaaagcaccaaaggcttgttcgatattgtgatttgctaggtcggtctaaagaaatttgacaaccattctccaacatgtatttctctcctcttcttcctattcttcattcctattatgctgaagaagttggagtctatgtgggtgttctttcgtctaacagactctagatctcgttgaagcataaggtggttggtgctttgctttcttggaattattgtgacttctaattgtcaaatttgtatttcatggttcccacctttttcttaacataagttttatgtattaatagactggaatatcccagttaggattactaccttgtttgcttgaagatatatataatatctacattattttgcatttagttataatgcttgctctattcaaaaaaaaaaaaaaaaaa

SEQ ID NO: 68 - protein, 197 aa, Medicago truncatula
MSASRFIKCVTVGDGAVGKTCLLISYTSNTFPTDYVPTVFDNFSANVVVNGSTVNLGLWDTAGQEDYNRLRPLSYRGADVFILAFSLISKASYENVSKKWIPELKHYAPGVPIILVGTKLDLRDDKQFFVDHPGAVPITTAQGEELRKLINAPAYIECSSKSQQNVKAVFDAAIRVVLQPPKQKKKKSKAPKACSIL

SEQ ID NO: 69 - DNA, 985 bp, Medicago truncatula
  CDS (143)..(736)
gttcaacgctaaaatcacactctcatcttccaaatagatgtgtgatagtaattgaaagagaagaagaagaagaaagtactggaggagggggactgtcctcaggtgaagatctgaggctattttgggtatttcatttttcaagatgagtgcttctaggtttattaaatgtgttactgttggtgatggagctgttggcaaaacttgtttgttgatttcttacaccagcaatactttccccacggattatgtgccgacagtttttgacaatttcagtgcgaatgtggttgttaatggaagtattgtgaatctgggtttgtgggatactgctggacaagaggattataacagattaagacctttgagttaccgtggtgccgatgttttcatattggctttctctctcataagcaaagccagttatgaaaatgtctccaaaaagtggattccagagttgaagcattatgcacctggtgtccccataattctggttggaacaaagcttgatcttcgggatgataagcagttctgcatagaccatcctggtgccgttcccattaccacagctcagggagaagagctgaggaagctgattaatgcaccagcttacattgaatgcagttcaaaatcacaggagaacgtgaaggcggtgtttgatgcagccataagagttgtccttcaaccaccaaagcagaagaaaaagaagaataaagcacaaaaggcctgttcaatattgtaattcactaggtgtaaacatttgattgtcctttgttctacctgtattcccctccccttcttttcatcattttctttgttattgaagaagttggagagtctttgtgggtgttctttcagacaaatactctagatctccttgaagcataaggtggcttaatgtttttgctttctatgaattattattgtcaactctaatagttaaatttgcatttcatgcttcccatctttttaaaaaaaaaaaaaaaaaaaa

SEQ ID NO: 70 - protein, 197 aa, Medicago truncatula
MSASRFIKCVTVGDGAVGKTCLLISYTSNTFPTDYVPTVFDNFSANVVVNGSIVNLGLWDTAGQEDYNRLRPLSYRGADVFILAFSLISKASYENVSKKWIPELKHYAPGVPIILVGTKLDLRDDKQFCIDHPGAVPITTAQGEELRKLINAPAYIECSSKSQENVKAVFDAAIRVVLQPPKQKKKKNKAQKACSIL

SEQ ID NO: 71 - DNA, 779 bp, Brassica napus
  CDS (183)..(776)
ggctcatagggtttctagttttcgggagaaagttctttcatttttcaagaatgcccagatgctcgattgaggttgagcatccagacaacgaagaagaaaattaacaaaatctttgagcttttctttttatttttggtttttcccccctgaaagtattaacaaataatcttcgagtagagaaaatgagcgcatctcggttcataaagtgtgtaacggttggtgatggagctgtcggaaaaacatgtttgttgatttcttacacaagcaacactttccctacggactatgtgcccaccgttttcgataatttcagtgctaatgtggtggttaacggagccaccgttaatcttggattgtgggatactgcagggcaagaggattacaacagattaagaccactaagctaccgtggagctgatgttttcatattggccttctctcttatcagtaaagccagttatgaaaacgtctccaaaaagtggatcccggagttgaagcattacgcgcctggtgtccccgtcatccttgttggatcaaagcttgatcttcgagatgataagcaattcttcgtcgaccatcctggcgctgtcccgattacaactgctcagggagaggagctgaggaagctaatagatgcacctacttacatcgaatgcagttccaaatctcaagagaatgtgaaagctgtctttgacgcagccatacgagtggtgttgcaaccgcctaagcagaagaagaaaaagagcaaagcgcagaaggcatgctccatccagtgatat

SEQ ID NO: 72 - protein, 197 aa, Brassica napus
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPVILVGSKLDLRDDKQFFVDHPGAVPITTAQGEELRKLIDAPTYIECSSKSQENVKAVFDAAIRVVLQPPKQKKKKSKAQKACSIQ

SEQ ID NO: 73 - DNA, 757 bp, Brassica napus
  CDS (164)..(757)
cgatacaccgattcatttcattcttcattgatcgcttcctctcacatacccgatttcgtttagggttaacattttctagggttttagagataggcgaaactgaaattgagaagaagacgggtgttgtttcctcatagatctgaggggttgaatttttcgatttatgagcgcatctcggttcataaagtgcgtgacggttggggacggagcagtgggcaaaacatgtctcctcatctcttacaccagcaacactttccctacggattatgttccaactgttttcgataacttcagcgctaatgttgttgttaacggagccactgtcaacttaggactctgggataccgcagggcaggaggattataacagattgagacccttgagttaccgcggtgctgacgttttcatcttggccttctctctcatcagtaaggctagttatgagaatgtctccaagaagtggatccctgagctgacccactatgcccctggtgtccctatcgttcttgttggtaccaaactagatcttagggatgacaaacagttcttcgttgaccaccctggtgctgtacctattaccacttctcagggagaggaactaatgaagctaattggagctccttcgtacatcgagtgcagttcaaaatctcaagagaacgtgaaaggggtgtttgatgcagcgatcagagtggtacttcaacctccaaagcagaagaaaaagaagagcaaggcacaaaaggcctgctccattttgtaa

SEQ ID NO: 74 - protein, 197 aa, Brassica napus
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELTHYAPGVPIVLVGTKLDLRDDKQFFVDHPGAVPITTSQGEELMKLIGAPSYIECSSKSQENVKGVFDAAIRVVLQPPKQKKKKSKAQKACSIL

SEQ ID NO: 75 - DNA, 645 bp, Oryza sativa; identical to SEQ ID NO: 39
  CDS (1)..(645)

SEQ ID NO: 76 - protein, 214 aa, Oryza sativa; identical to SEQ ID NO: 40

SEQ ID NO: 77 - DNA, 1135 bp, Homo sapiens (man)
  CDS (105)..(680)
ggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagagaggtctgaagaatgtgtttgatgaggctatcctagctgccctcgagcctccggaaactcaacccaaaaggaagtgctgtatattctaaactgttttctccttcccttctttgctgctgcttcctgtcccactactgtagaaagatcgtttaaaaacaaaggaataaaaccatcctgtttgaaagcctctgcgtctttttactcaccaccttagagcaacctctgtattagtttttgatcaagaattgcaatatcatataaattttttgtgatcagtagtcaagttggacttgttttaacgttctgctgcttgagttgcctgatgctcagagctttttggtttggattactattgcaaagggaacttggtctggcttagatgtcctcttggagaaaataacaagagttttaacacttctagatcttagttcagatggagaaagtaacacaaacatcattttactcttatgatcaattgttaattgtaattgcatgacaaaccttatggaaaaggggtgacctagtagagtgtaatggggaaggg

SEQ ID NO: 78 - protein, 191 aa, Homo sapiens (man)
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQRGLKNVFDEAILAALEPPETQPKRKCCIF

SEQ ID NO: 79 - DNA, 576 bp, Caenorhabditis elegans
  CDS (1)..(576)
atgcaagcgatcaaatgtgtcgtcgttggtgacggagccgtcggtaaaacgtgtctcctgatatcctacaccacaaacgcatttcccggagaatatattccgacggtattcgacaactactcagcaaatgtgatggtcgacggtcggccgataaatctcgggctctgggatacagctggacaggaagattacgatcgactccgaccactgtcatatccacaaacagacgtgtttctcgtatgctttgccctgaacaatccggcgagttttgagaatgttcgtgcgaaatggtatccagaagtgtcacatcattgcccgaatacgccgattattttggttggaacgaaagctgatctgcgtgaggatcgagatactgttgaacggctccgcgaacgccggctccaaccagtgagccaaacccagggctacgtgatggcaaaggaaatcaaggctgtcaagtatctggagtgctcggcgctcacgcaacgtggtctgaaacaagttttcgatgaggcgatccgagccgtcgtcacgccgccacaaagagccaaaaagagcaagtgtacggtgctctaa

SEQ ID NO: 80 - protein, 191 aa, Caenorhabditis elegans
MQAIKCVVVGDGAVGKTCLLISYTTNAFPGEYIPTVFDNYSANVMVDGRPINLGLWDTAGQEDYDRLRPLSYPQTDVFLVCFALNNPASFENVRAKWYPEVSHHCPNTPIILVGTKADLREDRDTVERLRERRLQPVSQTQGYVMAKEIKAVKYLECSALTQRGLKQVFDEAIRAVVTPPQRAKKSKCTVL

SEQ ID NO: 81 - DNA, 579 bp, Caenorhabditis elegans
  CDS (1)..(579)
atggctgcgattagaaagaagttggtgatcgtcggcgacggagcctgcggtaaaacttgcctgctcatcgttttctcaaaggatcagttcccagacgtgtatgtgccgactgttttcgagaattatgttgccgacattgaagttgacggaaagcaggtcgaacttgctctatgggatacagctggacaagaggactatgatcgtctgcgtccactctcttatccggatactgacgtcattctgatgtgcttctcaattgattcacccgattcactggagaatattccagaaaaatggacaccagaagtcaggcatttctgtccaaatgttccgattattttggtcggaaataaacgagatcttcgtagtgatccacagactgttcgagaattggcaaaaatgaaacaggagcccgtgaagcctgagcagggacgagcaattgctgagcaaattggagcatttgcatatttggagtgctctgcgaagactaaggacggaattcgtgaggtattcgagaaggcgacacaggcggcattgcaacagaagaagaaaaagaagagcaagtgcatgattttgtaa

SEQ ID NO: 82 - protein, 192 aa, Caenorhabditis elegans
MAAIRKKLVIVGDGACGKTCLLIVFSKDQFPDVYVPTVFENYVADIEVDGKQVELALWDTAGQEDYDRLRPLSYPDTDVILMCFSIDSPDSLENIPEKWTPEVRHFCPNVPIILVGNKRDLRSDPQTVRELAKMKQEPVKPEQGRAIAEQIGAFAYLECSAKTKDGIREVFEKATQAALQQKKKKKSKCMIL

SEQ ID NO: 83 - DNA, 928 bp, Schizosaccharomyces pombe
  CDS (55)..(633)
gaattcaataaagtgaagcaaagctttacgattaattattttttgtgaaatagtatgcccaccattaagtgtgtcgtagtaggagacggtgctgtaggaaagacctgtctgcttatttcctatactacaaacaagtttcctagtgactatgtgccaactgtattcgataattatgctgtcactgtcatgatcggtgatgaaccatacactcttggtttattcgataccgctggtcaggaggattatgatcgcttgcgtcctttatcctatcctcaaacagacgtctttttggtttgttttagtgtaacttctcctgccagttttgaaaatgtgaaagaaaagtggtttcccgaagttcatcatcattgtccgggcgtcccgtgcttaattgttggtacccaaattgatttacgtgatgacccttctgtgcaacagaaactagctcgccagcatcagcatccccttacacatgagcaaggtgaacgattagctcgtgagttgggtgctgtcaagtatgttgagtgttccgctttgacccaaaaagggttaaagaatgtttttgatgaagctattgtagccgctcttgatcctcctgttcctcacaagaaaaagtcaaagtgtttggtactgtaatttaaccctggttttctttccttttccgaaatttccttaatacagctagtttacaacagtaaacaatgtcttagctttctttaacgatccctcatatttgcaaagatatttgctatttgttattttcatcctagcttttgtgcttcttcattcattctgtcaatcacacacttcttgggctttacatatctgtgttttctggctaggcatatttcctttttccgttaaataaacgacgattttgctatacttttgctacattattgtattcttctgccattactcgcaggaattc

SEQ ID NO: 84 - protein, 192 aa, Schizosaccharomyces pombe
MPTIKCVVVGDGAVGKTCLLISYTTNKFPSDYVPTVFDNYAVTVMIGDEPYTLGLFDTAGQEDYDRLRPLSYPQTDVFLVCFSVTSPASFENVKEKWFPEVHHHCPGVPCLIVGTQIDLRDDPSVQQKLARQHQHPLTHEQGERLARELGAVKYVECSALTQKGLKNVFDEAIVAALDPPVPHKKKSKCLVL

SEQ ID NO: 85 - DNA, 579 bp, Mus musculus (house mouse)
  CDS (1)..(579)
atgcaggccatcaagtgtgtggtggtgggtgatggagccgtgggcaagacgtgtcttctcatcagctacaccaccaacgccttccctggagaatacatccccactgtatttgacaactactcagccaatgtgatggtggacagtaagccggtgaacctggggctgtgggataccgcaggtcaggaggactatgaccgcctccggccactctcctacccacagacagatgtatttctcatctgcttctcgctagtcagcccagcctcctatgagaatgtccgtgccaagtggttccctgaggtacggcaccactgccccagcacccccatcatcctggtgggtaccaagctggaccttcgcgatgacaaggacaccatcgagaagctgaaggagaagaagctggctcccatcacctacccgcagggcctggcactggccaaggatattgattcagtcaagtacttggaatgttctgcactcacccagcgaggcctgaagaccgtcttcgatgaggcaatccgcgcagtcctctgcccacagcccacacgacagcagaagcgcccctgcagcctgctctag

SEQ ID NO: 86 - protein, 192 aa, Mus musculus (house mouse)
MQAIKCVVVGDGAVGKTCLLISYTTNAFPGEYIPTVFDNYSANVMVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKDIDSVKYLECSALTQRGLKTVFDEAIRAVLCPQPTRQQKRPCSLL

SEQ ID NO: 87 - DNA, 840 bp, Discopyge ommata
  CDS (97)..(675)
gaccggcgcgccattggacggtcgctaggcggaggcggaagggattggttgccgtgcgacgtcagtcaggtgcttcaggagcgacggggcacagcgatggcagcgatccggaagaagctcgtcatcgttggcgatggagcttgtggcaagacctgcctcctgatcgtcttcagcaaggaccagttcccggaggtctacgtccccactgtcttcgagaactacgtggcagacatcgaggtggacgggaagcaggtggagctcgctctctgggacacggctggacaggaggactatgaccgcctgcgacccctctcctaccctgacaccgacgtcattctgatgtgcttttctatcgacagccccgacagcttggagaacattccggagaagtggaccccggaggtgaagcacttctgccccaacatccccatcatcctggtgggcaacaagaagactgcgggggacgagcacacacggagggagctagccaagatgaagcaggagcctgtcaaaccagatgatgccaaggagatggggagccgcatcaaagcctttggctacctggaatgctcagcgaagacgaaggaaggcgtgcgcgaggtctttgagctggcctcgcgcgctgctctgcaggccaagaaaaccaagagcaagagcccctgtctgcttctgtgagcaggagctcccagctatccccacttctctctgcttctgctcactctccgtcctccccctctcccattccttctctttcctccctcgttcttccctctcttgtttctccccatctctctcctccctctcgttctttcctctcctcttgttttcctccttgagcgc

SEQ ID NO: 88 - protein, 192 aa, Discopyge ommata
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNIPIILVGNKKTAGDEHTRRELAKMKQEPVKPDDAKEMGSRIKAFGYLECSAKTKEGVREVFELASRAALQAKKTKSKSPCLLL

SEQ ID NO: 89 - DNA, 697 bp, Canis lupus familiaris (dog)
  CDS (1)..(582)
atggctgccatccggaagaaactggtgattgttggtgatggagcctgtggtaagacttgtttgctcatcgtctttagcaaggaccagttcccagaggtgtatgtacccacagtgtttgagaactatgtggcagatattgaagttgatggaaagcaggtagagttggctttgtgggatacagctgggcaggaagattatgatcgcttgaggcctctctcctatccagacactgatgttatactgatgtgtttctctattgacagccctgatagcttagaaaacatcccagaaaaatggaccccagaagtcaagcacttctgtcccaacgtgcccatcatcctggttgggaacaagaaggatcttcggaatgatgagcacacaaggcgggagctagccaagatgaagcaggagccggtgaaaccgacagaaggcagagatatggcaaacaggattggtgcttttgggtacatggagtgttcagcaaagaccaaagatggagtgagggaggtttttgaaatggccacgagagctgctctgcaagccagacgtgggaagaaaaaatctgggtgccttgtcttgtgaaaccctgctgcaagcacagccctcatgcggttaattttgaagtgctgtttattaatcttagtgtatgattactggcctttttcatttatctataatttacctaagattacaaatc

SEQ ID NO: 90 - protein, 193 aa, Canis lupus familiaris (dog)
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNKKDLRNDEHTRRELAKMKQEPVKPTEGRDMANRIGAFGYMECSAKTKDGVREVFEMATRAALQARRGKKKSGCLVL

SEQ ID NO: 91 - DNA, 705 bp, Drosophila melanogaster
  CDS (25)..(603)
tagcactcagtcagaaatcgaaccatgcaggcgatcaagtgcgtcgtcgtgggcgacggagccgtgggaaagacctgcctgctgatcagctacacgaccaatgcctttcccggcgagtacatacccaccgtgttcgacaactactcggccaacgtgatggtggacgccaagcccatcaacctgggcctgtgggatacggccgggcaggaggactacgaccgactgaggccactgtcttatccccagaccgatgtcttcctcatctgcttctcgctggtgaatccggcatcgttcgagaacgtgcgggccaagtggtatccggaggtgcgccaccactgccccagcacgcccatcatcctggtgggcaccaagctggatttgcgcgacgacaagaacacaatcgaaaagctgagggacaagaaactggtgcccatcacctatccgcagggcctggccatggccaaggaaatcggagcggtcaagtatctggagtgctcggccctgacgcagaagggtctgaaaaccgttttcgacgaggccatccggtcggttttgtgccccgtgctgcagcccaagtccaagcgcaagtgcgccctgctctaaaagagttagacagttggtcggtggtgttccaccgcagcgactcctgcttaaacgctacactactctactctaacctataataaccattatgtaacctaagcc

SEQ ID NO: 92 - protein, 192 aa, Drosophila melanogaster
MQAIKCVVVGDGAVGKTCLLISYTTNAFPGEYIPTVFDNYSANVMVDAKPINLGLWDTAGQEDYDRLRPLSYPQTDVFLICFSLVNPASFENVRAKWYPEVRHHCPSTPIILVGTKLDLRDDKNTIEKLRDKKLVPITYPQGLAMAKEIGAVKYLECSALTQKGLKTVFDEAIRSVLCPVLQPKSKRKCALL

SEQ ID NO: 93 - DNA, 801 bp, Drosophila melanogaster
  CDS (160)..(735)
ctcgcacgcaaagagctcgctggagagagagaacgctaacacaaaaggaaatagtagttttccgtacgtatcgagcccagcccagaaaagcggaaaactaaacggattcgacagcggttgcaaattttaaataactgagtcatcacccctctgcacaacatgcaaaccatcaagtgcgtggtcgtcggcgacggagccgtgggtaagacatgcctgctcatctcgtatacaaccaacaagttcccgtcggagtacgtgcccacggtgttcgacaactatgcggtcactgtgatgatcggcggtgagccctacacactgggcctgttcgatacggccggacaggaggattacgatcggctgcgtccgctctcctatccgcagacggatgtcttccttgtctgcttttcggtggtcagtcccagttccttcgagaacgtcaaggagaagtgggtgcccgagattacacaccattgccaaaagacgccgttcctgctggtgggcacacagattgatttgcgcgacgagaacagcacgctggagaagctggccaagaacaagcagaagcccatcaccatggagcagggcgagaagctggccaaggagctgaaggccgtcaagtacgtggagtgctcggccttgacacagaagggcctgaaaaatgtattcgacgaggccatcctggccgccctcgagccaccagagcccacaaagaaaaggaagtgcaaattcttataattctgctttcctcacacgcggtatccctttcattctggctttctactatcgcaatgactccttccc

SEQ ID NO: 94 - protein, 191 aa, Drosophila melanogaster
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCQKTPFLLVGTQIDLRDENSTLEKLAKNKQKPITMEQGEKLAKELKAVKYVECSALTQKGLKNVFDEAILAALEPPEPTKKRKCKFL

SEQ ID NO: 95 - DNA, 609 bp, Schizosaccharomyces pombe
  CDS (1)..(609)
atggcgacagaacttcgcagaaagctcgttattgtgggagatggtgcatgtggtaaaacatgcttattaattgtattttctaaaggaacctttcccgaggtctatgttcccactgtttttgaaaattatgtagctgatgttgaggttgatggacgccacgttgagttggctctttgggatacggctggacaagaagattacgaccgtctacgtcccttgtcatatcctgactcacatgttatccttatttgctttgctgttgattctcccgattctcttgacaatgttcaagaaaaatggatttccgaggttctccatttctgttccagtcttcctattttgcttgtcgcttgcaaggctgatctccgtaacgacccaaaaattattgaggagttatccaagactaatcagcatcccgtcaccacagaagaaggtcaagcagtagctcagaagattggtgcttacaaataccttgagtgttctgccaagacgaatgaaggtgttcgtgaggtttttgaatcagccactcgtgctgctatgctcaaacacaagcccaaagtgaagccctctagtggaactaagaagaagaagcgttgtatcttgttgtaa

SEQ ID NO: 96 - protein, 202 aa, Schizosaccharomyces pombe
MATELRRKLVIVGDGACGKTCLLIVFSKGTFPEVYVPTVFENYVADVEVDGRHVELALWDTAGQEDYDRLRPLSYPDSHVILICFAVDSPDSLDNVQEKWISEVLHFCSSLPILLVACKADLRNDPKIIEELSKTNQHPVTTEEGQAVAQKIGAYKYLECSAKTNEGVREVFESATRAAMLKHKPKVKPSSGTKKKKRCILL

SEQ ID NO: 97 - DNA, 603 bp, Schizosaccharomyces pombe
  CDS (1)..(603)
atgttgcaatctcaaccgattagaaggaaactagtagttgtaggcgatggtgcctgcgggaagacgtctttgttatccgttttcactttgggatattttcctactgaatatgttccgactgtgtttgaaaactatgtttcagattgtcgagttgatggaaaatcagttcaactggcattgtgggataccgcaggtcaagaggaatatgagagattaagaccaatgtcttacgctaaagcacacattattttggttgggtttgcgatagactctcctgattcacttgaaaatgtttctacgaagtggattgaggaaattaatacactttgcccaaatgttccgtttattttagtgggcatgaaagccgacttaaggtcagatcccgttgctattgaagaaatgcgacgtcgaaatcaaaattttgtaaaatcacaacaggctgaattagtagctcagcggattggtgcgagaaagtatatggaatgttcttcattgactggtgacggcgtggacgatgtatttgaagctgctactagggcagcactaacagttcgggattcggaaaatgacaagagttctacaaaatgctgcatcatttcataa

SEQ ID NO: 98 - protein, 200 aa, Schizosaccharomyces pombe
MLQSQPIRRKLVVVGDGACGKTSLLSVFTLGYFPTEYVPTVFENYVSDCRVDGKSVQLALWDTAGQEEYERLRPMSYAKAHIILVGFAIDSPDSLENVSTKWIEEINTLCPNVPFILVGMKADLRSDPVAIEEMRRRNQNFVKSQQAELVAQRIGARKYMECSSLTGDGVDDVFEAATRAALTVRDSENDKSSTKCCIIS

SEQ ID NO: 99 - DNA, 726 bp, Entamoeba histolytica
  CDS (97)..(687)
aaatgtaaagaacattaaaaataaaaaaacagtgaaaagaaatggattaaaaatagaatttcaaggaactgaaactcgtaattcaaaagaaaacacatgcaagctgtcaaatgtgtcattgttggggatggagctgtaggaaaaacttgtcttttaatttcttacactacaaatgcatttcctaatgaatatattccaacagtatttgataattattctgctactgttatggttgattcaaaaccaattaatcttggactttgggatactgctggacaagaagattatgatagattaagaccattgtcatatccacaaaccgatgtattcttaatttgtttctcagttgtttctccaccatcatttgataatgtctcatctaaatggcaaccagaagtttctcatcattgtccaaagactccttgtttattagttggaactaaacttgatatgagagaagataaagaacaattaaagagattagaagagaaaaaaattactccaatcactactgaacaaggtgaggctaaatgcaaagatattggagctgttaagtatatcgaatgttctgctttaactcaaaagaatttaagacttgtttttgatgaagctgttagagcagttatttctcctgcaggtggagcaaaaaaggataaaaagaataatagaggatgtttattattctaaattcgattcattccttttttaaacaacttacaaacaata

SEQ ID NO: 100 - protein, 196 aa, Entamoeba histolytica
MQAVKCVIVGDGAVGKTCLLISYTTNAFPNEYIPTVFDNYSATVMVDSKPINLGLWDTAGQEDYDRLRPLSYPQTDVFLICFSVVSPPSFDNVSSKWQPEVSHHCPKTPCLLVGTKLDMREDKEQLKRLEEKKITPITTEQGEAKCKDIGAVKYIECSALTQKNLRLVFDEAVRAVISPAGGAKKDKKNNRGCLLF

SEQ ID NO: 101 - DNA, 744 bp, Entamoeba histolytica
  CDS (145)..(729)
aaatataatcttaaaatagaaagaactgcaaaaactaaaaaacataaaaaaagaaactctagaaaagctattaaagtaacgaaaaaaacatgaaacaaagaaataatagacaactcagaactaaaaaaagttgaaagaaaatcaatgagtgaaaaacccacatcaatcaaattagtcgttgttggggatggtgctgttggaaaaacatgtttattaatttgctatacaactaatgaatttccaaaagattatattcctacagtattcgataattatgttgtgtcattaactgcaggcacaagacaaattcaattggcgttgtgggatactgctggacaagaagagtatgatcaattgagaccattgagttattcatctgcttcaatatttttaatatgtttctctgtcacaagttctgtatcatatgataatgtaattacaaaatggcaccctgaagttattcactttgcaccaaaagttcctattatattagttggaacaaaacttgatactagaaatgatcctgctattgttaaaagattaacagaacagggtatgactgttattaatactgcaaaaggagaagaacttaaaaatcgtataaaagctgtcaaatatattgaatgttctgcaaaaacaagcgaaaatttaaagacagttttcgatgaagcagttaaaactgtgttaatgaataaaccacagcaaaggtcaaagtgtgctcttttataattcacttttaaatta

SEQ ID NO: 102 - protein, 194 aa, Entamoeba histolytica
MSEKPTSIKLVVVGDGAVGKTCLLICYTTNEFPKDYIPTVFDNYVVSLTAGTRQIQLALWDTAGQEEYDQLRPLSYSSASIFLICFSVTSSVSYDNVITKWHPEVIHFAPKVPIILVGTKLDTRNDPAIVKRLTEQGMTVINTAKGEELKNRIKAVKYIECSAKTSENLKTVFDEAVKTVLMNKPQQRSKCALL

SEQ ID NO: 103 - DNA, 588 bp, Caenorhabditis elegans
  CDS (1)..(588)
atgcaagcaatcaaatgtgtcgtcgttggtgacggagccgtcggtaagacgtgtctcctgctatcgtacactacaaacgcttttcccggagaatatattctaacggtattcgacacctactcaacaaatgtgatggtcgacggaaggccaataaatctcagcctatgggacacagctggacaggacgattacgatcaattccgccacctgtcatttccacaaacagacgtattcctcgtatgctttgcactgaataatccagcaagttttgagaatgttcgtgcaaaatggtatccagaagtatcacatcattgcccaaatacaccgattattttggttggaactaaagctgatttacgcgaggatcgagatactattgaacggctccgtgaacgtcggctccaaccagtgagccacacccagggttacgtgatggcaaaggaaatcaaggcggtcaagtacctggaatgctcggcgcttacccaaattggattgaaacaagttttcgatgaggcaattcgtactgggctcaccccgccacaaacaccacaaacgagagccaaaaagagcaattgcacggtgctttaa

SEQ ID NO: 104 - protein, 195 aa, Caenorhabditis elegans
MQAIKCVVVGDGAVGKTCLLLSYTTNAFPGEYILTVFDTYSTNVMVDGRPINLSLWDTAGQDDYDQFRHLSFPQTDVFLVCFALNNPASFENVRAKWYPEVSHHCPNTPIILVGTKADLREDRDTIERLRERRLQPVSHTQGYVMAKEIKAVKYLECSALTQIGLKQVFDEAIRTGLTPPQTPQTRAKKSNCTVL

SEQ ID NO: 105 - DNA, 594 bp, Zea mays (maize)
  CDS (1)..(594)
atgagcgcgtccaggttcataaagtgcgtcacggtcggggacggcgccgtcggcaagacctgcatgctcatctcctacacctccaacaccttccccaccgactatgttccgacagtgtttgataacttcagtgccaacgttgtggttgatggtaatactgtcaacctcggcctctgggacactgcaggtcaagaggattacaacagactgagaccactgagctatcgtggagctgatgtttttcttctggctttctcactgatcagtaaggccagctatgagaatgtttcgaagaagtggatacctgaactgaagcattatgcacctggtgtgccaattattctcgtagggacaaagcttgatcttcgagacgacaagcagttctttgtggaccatcctggtgctgtccctatcactactgctcagggagaggagctaagaaagcaaataggcgctccatactacatcgaatgcagctcgaagacccaactaaacgtgaagggcgtctttgatgcggcgataaaggttgtgctgcagccgcctaaggcgaagaagaagaaaaaggtgcagaggggggcgtgctccattttgtga

SEQ ID NO: 106 - protein, 197 aa, Zea mays (maize)
MSASRFIKCVTVGDGAVGKTCMLISYTSNTFPTDYVPTVFDNFSANVVVDGNTVNLGLWDTAGQEDYNRLRPLSYRGADVFLLAFSLISKASYENVSKKWIPELKHYAPGVPIILVGTKLDLRDDKQFFVDHPGAVPITTAQGEELRKQIGAPYYIECSSKTQLNVKGVFDAAIKVVLQPPKAKKKKKVQRGACSIL

SEQ ID NO: 107 - DNA, 1058 bp, Zea mays (maize)
  CDS (176)..(769)
gaattcggcacgagagctctcaagacggccgacggccggcttgcctacctgctcccatccttcccgagggaccgagaaagataagaaaggcggtggtcaacttgtgtcctgaggtgcccgtagaagcccaaggacaagaaacaaggagaagagtagatctacatctactccaccgatgagcgcgtctcggttcatcaagtgcgtcaccgtgggggacggtgccgtcggaaagacctgcatgctcatctcctacacatccaacactttccccactgactatgttccaactgtgttcgacaacttcagtgccaatgttgtggttgacgggagcactgtcaacttgggtctgtgggatacagcaggacaagaagattacaatagactgcgtccgttgagctatcgtggtgctgatgtttttctgctcgccttttctcttatcagcaaagcaagctatgagaatgtctctaagaagtgggttcctgaattaaggcactatgctcctggcgtgcccataatccttgttgggacaaaacttgatctgcgtgatgataagcagttttttgttgatcaccctggtgctgttccaatttccactgcccagggcgaagagctgaggaagctaattggtgctgccgcctacatcgaatgcagttcaaaaatccagcagaacataaaagcagtgtttgacgcagcaattaaggtggttctccagccaccaaagcaaaagaagaggaagaagaaggtgcagaagggatgcaccattttgtaactacaaacggtagagggcaacagtctggctgcggcgctgctgccaatgataaccatcgcctccttgctgtataatatatcgcctgatcatgccaccagcatgcacaagggagatggtggttttaggatccttgtcctactgtgttgtgtagaccaccgggtgtagttgactgtatctggttgtttgtatgtatggacaagacaaaactagcactgcagatggtatggtaaggcgtaagcaaatacaatatgacattggtccagttccaggaaaaaaaaaaaaaaaaaaa

SEQ ID NO: 108 - protein, 197 aa, Zea mays (maize)
MSASRFIKCVTVGDGAVGKTCMLISYTSNTFPTDYVPTVFDNFSANVVVDGSTVNLGLWDTAGQEDYNRLRPLSYRGADVFLLAFSLISKASYENVSKKWVPELRHYAPGVPIILVGTKLDLRDDKQFFVDHPGAVPISTAQGEELRKLIGAAAYIECSSKIQQNIKAVFDAAIKVVLQPPKQKKRKKKVQKGCTIL

SEQ ID NO: 109 - DNA, 1045 bp, Zea mays (maize)
  CDS (45)..(707)
gaattcggcacgagctggctcgtgcagcggcggcagtgagagcgatgagcgcggcggcagcggcggcggcgagctcggtcaccaagttcatcaagtgcgtcacggtcggcgatggggccgtcgggaagacctgcatgctcatctgctacacctgcaacaagttccccacggattacatccccaccgtatttgacaacttcagcgccaatgtctccgtgggtgggagcatcgtcaacttgggcctctgggacacggcaggccaggaggattacagcaggttgaggcctctcagctacaggggtgctgatgtgttcatcctctccttctccctggtcagcagggcgagctatgagaacgtcctgaagaagtggatgccagagcttcgccgattttcacctactgttcctgtagttcttgttggaaccaaactagatctccgtgaagacagatcttaccttgctgaccattctgctgcttccatcatctctactgaacagggagaagagctcaggaagcagataggtgctgtggcgtacatagaatgcagctcaaagacacagaggaacgtaaaggctgtgttcgacactgcaattaaagtagtgctgcaaccaccgaggagaagagaagttaccaggaagaaaatgaagacaagttcgaatcagtctctgagaagatacctctgtggaagcggatgtttcacatcgtaaagcacagactcttctgcgactgttgtactggacttgctagatggttgcagctctatgaatgagtagtcccctccgcagccactgggaacttctggttctctgctaccttccgatagagtgctcttttgcgttcaccagctgagaaaaatgaagcgaggttctagtttataaattccctacgaggtgtaccttctttagtatgaatggtgggctatttagcagttcagcaaagtgtgaagtgacccttctatgcatgttttgtttccaaaaactgatgttgctaaatggctaatgaatggttatggtcgcaccggaagaaaaaaaaaaaaaaaaaaaaa

SEQ ID NO: 110 - protein, 220 aa, Zea mays (maize)
MSAAAAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAASIISTEQGEELRKQIGAVAYIECSSKTQRNVKAVFDTAIKVVLQPPRRREVTRKKMKTSSNQSLRRYLCGSGCFTS

SEQ ID NO: 111 - DNA, 876 bp, Saccharomyces cerevisiae
  CDS (1)..(876)
atgaatacactattatttaagcgaaaaggtggcaattgtgggaacgaaagtaacatagtttcgcagggatcgccctcaagtagcaatcttcctgaatcacctggcactttagatgaaaagaatcttcccagattgcctactccattcgctagaagcctttctaccattcctagttatgagcagatgaaacgtacaaacaaactgccagattatcacctaaagattgttgttgtgggagatggcgctgtagggaagacgtgcctgctgatatcttatgtccaaggaacatttccgactgattatattcctactattttcgaaaattatgtcacaaacatagaaggacccaacggtcaaattatagaattggcattatgggacactgccggccaagaagagtatagtagacttagaccgctttcatatacgaatgcagatgtgctgatggtgtgctattctgttggtagtaagacatcgcttaaaaatgtggaagatctctggttcccagaggttaagcatttttgtccttccactccaatcatgctagtcggccttaaatcagatctatatgaagctgataacctttcagatctggtggaaccaagttcagcagaatccttggccaagcgtctgggggcatttgcacatattcaatgctcagcacgattgaaagaaaatatcgatgaagtatttgaaactgccatacacacgttactttccgattcattatatgctcccagagagcctacacatacaatcaaaaatccctttaaaagaaataccaccagatcagatatcgattcttctactggagataccagcgtctctatttccggaacgaaaagattaagaaaaaacaagtgtattataatgtaa

SEQ ID NO: 112 - protein, 291 aa, Saccharomyces cerevisiae
MNTLLFKRKGGNCGNESNIVSQGSPSSSNLPESPGTLDEKNLPRLPTPFARSLSTIPSYEQMKRTNKLPDYHLKIVVVGDGAVGKTCLLISYVQGTFPTDYIPTIFENYVTNIEGPNGQIIELALWDTAGQEEYSRLRPLSYTNADVLMVCYSVGSKTSLKNVEDLWFPEVKHFCPSTPIMLVGLKSDLYEADNLSDLVEPSSAESLAKRLGAFAHIQCSARLKENIDEVFETAIHTLLSDSLYAPREPTHTIKNPFKRNTTRSDIDSSTGDTSVSISGTKRLRKNKCIIM

SEQ ID NO: 113 - DNA, 696 bp, Saccharomyces cerevisiae
  CDS (1)..(696)
atgtcatttctatgtgggtcagcttcaacgtcaaataaaccgatcgaaagaaagatcgttattttgggcgacggtgcctgtggtaaaacttcgttgctgaatgttttcaccagaggttattttcccgaagtttatgagcctactgtttttgaaaactatatccatgatattttcgttgacagtaaacatatcacgctatcgttgtgggatactgcgggccaagaggaatttgacaggttacgatccttgtcttattcagatacgcaatgtataatgttatgtttcagtattgattcacgcgattctttagaaaatgtccaaaataaatgggtgggtgaaatcactgatcattgtgaaggcgtcaagttagtcttagttgcactaaagtgtgacttaagaaacaatgaaaatgaatctaacgcaatcacaccgaacaatatccaacaggataacagcgtttctaacgacaacggaaataacataaatagcacctcaaacggcaaaaacctgataagttatgaagaaggtctagctatggctaaaaagatcggtgcgctacgttatttggaatgtagcgctaagctgaataaaggtgtcaacgaagctttcacagaagccgcaagagttgctttaaccgcgggcccagtagcaaccgaagtgaaaagtgacagtggatccagctgtaccattatgtaa

SEQ ID NO: 114 - protein, 231 aa, Saccharomyces cerevisiae
MSFLCGSASTSNKPIERKIVILGDGACGKTSLLNVFTRGYFPEVYEPTVFENYIHDIFVDSKHITLSLWDTAGQEEFDRLRSLSYSDTQCIMLCFSIDSRDSLENVQNKWVGEITDHCEGVKLVLVALKCDLRNNENESNAITPNNIQQDNSVSNDNGNNINSTSNGKNLISYEEGLAMAKKIGALRYLECSAKLNKGVNEAFTEAARVALTAGPVATEVKSDSGSSCTIM

SEQ ID NO: 115 - DNA, 579 bp, Drosophila melanogaster
  CDS (1)..(579)
atgacgacgattcgcaagaaattggtaattgtcggcgacggtgcctgcggtaaaacttgccttctgattgtcttcagcaaagatcagttccccgaggtctatgtgcccaccgtattcgagaattatgtggccgacatcgaggtggatggcaaacaggtggagctggccttgtgggatacggccgggcaggaggactacgacagactacgaccgctgagctatcccgacactgacgtcatactgatgtgtttctcagtggattcacccgattcgctagaaaatattcctgaaaaatggaccccagaggtcaaacacttttgtccaaatgttccaatcattttggtaggaaataagaaagatttgcgaaatgatcccaacacaattcgggatctagcaaaaatgaagcaggagccggtgaagccgcaggagggtcgcgccatggccgagaagattaatgcctttgcctatttggagtgttcggctaagtccaaggagggtgtgcgagatgttttcgagacggcaactagggccgcgctgcaagtcaaaaagaggaagaagaccagatgccttttgctctaa

SEQ ID NO: 116 - protein, 192 aa, Drosophila melanogaster
MTTIRKKLVIVGDGACGKTCLLIVFSKDQFPEVYVPTVFENYVADIEVDGKQVELALWDTAGQEDYDRLRPLSYPDTDVILMCFSVDSPDSLENIPEKWTPEVKHFCPNVPIILVGNKKDLRNDPNTIRDLAKMKQEPVKPQEGRAMAEKINAFAYLECSAKSKEGVRDVFETATRAALQVKKRKKTRCLLL

SEQ ID NO: 117 - DNA, 579 bp, Drosophila melanogaster
  CDS (1)..(579)
atgcaggcgatcaagtgcgtcgtcgtgggcgacggagccgtgggaaagacctgcctgctgatcagctacacgaccaatgcctttcccggcgagtacatacccaccgtgttcgacaactactcggccaacgtgatggtggacgccaagcccatcaacctgggcctgtgggatacggccgggcaggaggactacgaccgactgaggccactgtcctatccccagaccgatgtcttcctcatctgcttctcgctggtgaatccggcatcgttcgagaacgtgcgggcaaagtggtatccggaggtgcgccaccactgccccagcacgcccatcatcctggtgggcaccaagctggatttgcgcgacgacaagaacacaatcgaaaagctgagggacaagaaactggcgcccatcacctatccgcagggctctggccatggcaaggaaatcggagcggtcaagtatctggagtgctcggccctgacgcagaagggtctgaaaaccgttttcgacgaggccatccggtcggttttgtgccccgtgctgcagcccaagtccaagcgcaagtgcgccctgctctaa

SEQ ID NO: 118 - protein, 192 aa, Drosophila melanogaster
MQAIKCVVVGDGAVGKTCLLISYTTNAFPGEYIPTVFDNYSANVMVDAKPINLGLWDTAGQEDYDRLRPLSYPQTDVFLICFSLVNPASFENVRAKWYPEVRHHCPSTPIILVGTKLDLRDDKNTIEKLRDKKLAPITYPQGSGHGKEIGAVKYLECSALTQKGLKTVFDEAIRSVLCPVLQPKSKRKCALL

SEQ ID NO: 119 - DNA, 579 bp, Drosophila melanogaster
  CDS (1)..(579)
atgcaggccatcaagtgtgtggttgtgggcgacggagcggtgggaaagacctgtctgctgatcagctatacgaccaacgccttccccggcgagtacatacccacggtgttcgacaactattcggcgaatgtgatggtggatgccaagcccatcaatctgggcctctgggatacggctggacaggaggactacgatcgcctgaggccgctatcctatccgcaaacggatgtctttctcatctgtttctcactggtgaatccggcatcgtttgagaatgtgcgagccaaatggtttcccgaggtgcgtcatcattgcccgagtgtgccgataatcctggtcggcaccaaactggatctgcgcgacgataagcagacgatcgagaagctgaaggacaagaagctaacaccgatcacctatccccaaggactggcgatggccaaggaaatagctgcggtcaagtatctggagtgctcggccctgacccaaaagggtctgaagacggtcttcgacgaggccatacgatccgtgctatgtcctgtcgttcgaggacccaagcggcacaagtgcgccctgctctaa

SEQ ID NO: 120 - protein, 192 aa, Drosophila melanogaster
MQAIKCVVVGDGAVGKTCLLISYTTNAFPGEYIPTVFDNYSANVMVDAKPINLGLWDTAGQEDYDRLRPLSYPQTDVFLICFSLVNPASFENVRAKWFPEVRHHCPSVPIILVGTKLDLRDDKQTIEKLKDKKLTPITYPQGLAMAKEIAAVKYLECSALTQKGLKTVFDEAIRSVLCPVVRGPKRHKCALL

SEQ ID NO: 121 - DNA, 913 bp, Gossypium hirsutum (upland cotton)
  CDS (12)..(602)
gagaaaaaacaatgagcactgcaagatttatcaagtgtgtcacggtcggtgatggagctgtggggaaaacttgtatgctcatttcatataccagcaatactttcccaacggattatgttccaacagtatttgataactttagtgccaatgtggtggtggatggcagcacagtgaaccttggcctatgggacactgccgggcaagaagattataataggctaaggccactgagttatagaggagctgatgtgtttttgttggccttttctcttataagcaaggccagttatgaaaacatctacaaaaagtggatcccagagctaagacattatgctcataatgtaccagttgtgcttgttggaaccaaactagatttgcgagatgacaagcagttcctcattgatcaccctggagcaacaccaatatcaacatctcagggagaagaactaaagaagatgataggagcagttacttatatagaatgcagctccaaaacccaacagaatgtgaaggctgttttcgatgctgcaataaaagtagctttgaggccaccaaaaccaaagagaaagccttgcaaaaggagaacatgtgctttcctttgaatattggatcattattacagtcaaaaacagttaacaaaagctgttgcagataaacactgaatctgctatagtttgtttttggtttacatatgttccacgtgaaactatgaagcatctctaagaaaacccaaactatcatatcaacccatcgatcaatgaatcgatttcaattttcgcagtataagttccttttaatcctttctttttacttcattttataacgaattctatggataatgttccctacaaacatgtcattacaatgtttaattataaattccattcttctattttactaaaaaaaaaaaaaa

SEQ ID NO: 122 - protein, 196 aa, Gossypium hirsutum (upland cotton)
MSTARFIKCVTVGDGAVGKTCMLISYTSNTFPTDYVPTVFDNFSANVVVDGSTVNLGLWDTAGQEDYNRLRPLSYRGADVFLLAFSLISKASYENIYKKWIPELRHYAHNVPVVLVGTKLDLRDDKQFLIDHPGATPISTSQGEELKKMIGAVTYIECSSKTQQNVKAVFDAAIKVALRPPKPKRKPCKRRTCAFL

SEQ ID NO: 123 - DNA, 1067 bp, Arabidopsis thaliana (mouse-ear cress)
  CDS (314)..(907)
cttttctctctctagttgttgttctctctctctctcgcatcctccaattcatcgtcctcacgttcccttttgtttattcatcttccttccttcttcacatttctgattttctctatttggggggtttgtttccacattatacatatctagggttttgagatggttaattgaaagataatggtcgaagtttcggaggaattggcttcacattgtgggtgtttctggcttcctcaggtttaaatctgaggttgatctcttttgttttttggtaaattgtgacatattttggctcgaagaagaagaagaagaggcaatgagcgcatcaaggttcataaagtgcgtcaccgttggtgatggagctgttggtaaaacctgtttgctgatttcttataccagcaacacctttcccacggattatgttccgactgttttcgataactttagtgcaaatgtggttgtcaatggggccacggtgaatcttggattgtgggatactgcagggcaagaggactataacaggttaagacctttgagttaccgtggtgctgatgttttcattcttgccttctctctcattagtaaggctagttatgagaatgtttccaagaagtggattccagagttgaagcactatgctcctggtgtcccaattgtccttgttggaaccaaactagatcttcgagatgacaaacagtttttcatcgaccatcctggtgctgtccctattaccactgttcagggagaggagctgaagaagctaattggagcgccagcttacatcgagtgcagttcaaaatcacaagagaacgtgaagggcgtgtttgatgcagcgatcagagtggtccttcaacctccaaagcagaagaaaaagaagaacaaagcacaaaaggcctgctccatcttgtaatagcactcatggaagtcaagaagctctttgagatgaggatgacagggtggtttaaaaaagtatcgctttttcatttttgttgttgttttccgttttcatttgtgatctcttagttccgtacaaaacgaattgtgaggttaattcaacttctattttaact

SEQ ID NO: 124 - protein, 197 aa, Arabidopsis thaliana (mouse-ear cress)
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIVLVGTKLDLRDDKQFFIDHPGAVPITTVQGEELKKLIGAPAYIECSSKSQENVKGVFDAAIRVVLQPPKQKKKKNKAQKACSIL

SEQ ID NO: 125 - DNA, 695 bp, Arabidopsis thaliana (mouse-ear cress)
  CDS (1)..(594)
atgagcgcttcgaggttcataaagtgtgtcaccgttggcgacggagctgttggtaaaacctgtttgctgatttcttacaccagcaacacttttcctacggattatgtaccgactgttttcgataactttagcgcaaatgtggttgttaatggagccactgtgaatcttgggctatgggataccgcagggcaggaggattataacagattaagacctttgagttaccgcggtgctgatgttttcatcttagcattctctcttatcagtaaggctagttatgagaatgtctccaagaagtggatcccagagctgaagcattatgcccctggtgtccctatagttcttgttggaaccaaactagatcttcgggatgacaaacagttcttcattgaccaccctggcgctgtaccaattactactgctcagggagaggaactgaagaaactaattggagctcccgcatacatcgagtgcagttcaaaaacacaagagaacgtgaaaggagtatttgatgcagcgatccgagtggttcttcaacctccaaagcagaagaaaaagaaaagcaaagcacaaaaagcctgctccattttgtaatttctctacgcttctcttacgtatctctctctgtctctctgtctcttccactcttctagtgaaggcttaagaagaaaacacattgggcttaaaaattgttc

SEQ ID NO: 126 - protein, 197 aa, Arabidopsis thaliana (mouse-ear cress)
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIVLVGTKLDLRDDKQFFIDHPGAVPITTAQGEELKKLIGAPAYIECSSKTQENVKGVFDAAIRVVLQPPKQKKKKSKAQKACSIL

SEQ ID NO: 127 - DNA, 630 bp, Arabidopsis thaliana (mouse-ear cress)
  CDS (1)..(630)
atgagtgcttcgaagttcataaaatgtgttactgttggagatggggctgttgggaagacatgtatgcttatctgttacactagcaacaagtttcctactgattatataccgactgtgttcgacaatttcagtgccaatgtagctgtggatggacaaatcgttaatttagggctatgggacactgccggtcaagaagattacagtaggttaagaccattgagttatagaggagctgatatcttcgtcttagccttttcgcttattagcaaggcgagttacgaaaatgtactcaagaagtggatgcctgaacttcgtcggtttgcgccaaatgttcccatagttcttgttggtacaaagctagatctccgggatgacaagggatacctcgcggatcacaccaatgtcattacctctactcagggagaggaattgaggaagcaaattggtgcagctgcttatattgagtgtagttccaagactcaacaaaatgtgaaagcagtgtttgatacagcgatcaaggtggttcttcagcctccaaggaggaaagaggtcccgaggaggaggaagaatcatagaagatccggttgctccattgcgagtattgtctgtggaggttgcaccgctgcttaa

SEQ ID NO: 128 - protein, 209 aa, Arabidopsis thaliana (mouse-ear cress)
MSASKFIKCVTVGDGAVGKTCMLICYTSNKFPTDYIPTVFDNFSANVAVDGQIVNLGLWDTAGQEDYSRLRPLSYRGADIFVLAFSLISKASYENVLKKWMPELRRFAPNVPIVLVGTKLDLRDDKGYLADHTNVITSTQGEELRKQIGAAAYIECSSKTQQNVKAVFDTAIKVVLQPPRRKEVPRRRKNHRRSGCSIASIVCGGCTAA

SEQ ID NO: 129 - DNA, 588 bp, Caenorhabditis elegans
  CDS (1)..(588)
atgtcttcaccgtcgaggcagatcaaatgtgtagttgttggagacggaacagttggaaaaacatgcatgttaatatcttacacaactgactcttttccagttcagtatgtgcctacagtatttgataactattcggcacagatgagtcttgatgggaacgttgtgaacttaggattgtgggatactgctggacaggaggattatgatcgtttacgaccactttcctacccacagacggatgttttcattctctgcttctctgtcgtctcgcccgtatcgtttgacaatgtggcaagcaagtggattccggaaatacgacagcattgtccagatgcgcctgtcattctagttggtaccaaactcgatttgcgcgacgaggccgaaccgatgcgtgctctgcaggccgaaggaaagtccccaatttccaaaacgcaaggcatgaaaatggctcaaaaaattaaagctgtcaagtatttggaatgctctgcattgacgcaacagggactcacacaggtgttcgaagacgccgtacggtccattcttcatccgaaaccacagaaaaagaagaagtcttgcaatattatgtaa

SEQ ID NO: 130 - protein, 195 aa, Caenorhabditis elegans
MSSPSRQIKCVVVGDGTVGKTCMLISYTTDSFPVQYVPTVFDNYSAQMSLDGNVVNLGLWDTAGQEDYDRLRPLSYPQTDVFILCFSVVSPVSFDNVASKWIPEIRQHCPDAPVILVGTKLDLRDEAEPMRALQAEGKSPISKTQGMKMAQKIKAVKYLECSALTQQGLTQVFEDAVRSILHPKPQKKKKSCNIM

SEQ ID NO: 131 - DNA, 843 bp, Arabidopsis thaliana (mouse-ear cress)
  CDS (90)..(683)
acgcgtcgagaaactccaattccaaaggctaaatctttgagatctttttttttataaatttctctgaaattaataaactttgaggggaaatgagcgcttcgaggttcgtaaagtgcgtgacggttggtgatggagctgtcggaaaaacttgtttgttgatttcttacacaagcaacactttccctacggattatgtgcctaccgttttcgataatttcagtgccaatgttgtggttaatggaagcactgtgaatcttggattgtgggacactgcagggcaagaggattacaatagattaagaccactgagttaccgtggagcagatgttttcattttggccttctctcttatcagtaaagccagttatgaaaacgtctccaaaaagtggatcccggagttgaaacattacgcgcctggtgtccccatcgtccttgttggaacaaagcttgatcttcgagatgataaacagttctttatcgaccatcctggtgctgttccgattactactgctcagggagaggagctgaggaagcaaataggagcacctacttacatcgaatgcagttccaaaactcaagagaatgtgaaggcggtgtttgacgcagccatccgagtggtgttgcaaccgccaaagcagaagaagaagaagagcaaagcgcagaaggcatgctccattctatgatgattggaaatctctgtttttatgtatttggttttggtatattaatcttatatcaatgaatgaattaatgtgttaatggacagacacccaagtttgactggtcctttttgttcttaatattaatggagtttgtcggaaaaaaaaaaaaaaaaaaaaaaaa

SEQ ID NO: 132 - protein, 197 aa, Arabidopsis thaliana (mouse-ear cress)
MSASRFVKCVTVGDGAVGKTCLLISYTSNTFPTDYVPTVFDNFSANVVVNGSTVNLGLWDTAGQEDYNRLRPLSYRGADVFILAFSLISKASYENVSKKWIPELKHYAPGVPIVLVGTKLDLRDDKQFFIDHPGAVPITTAQGEELRKQIGAPTYIECSSKTQENVKAVFDAAIRVVLQPPKQKKKKSKAQKACSIL

SEQ ID NO: 133 - DNA, 841 bp, Arabidopsis thaliana (mouse-ear cress)
  CDS (28)..(633)
aaggaattgaagacaaaagcaaagaaaatgagcacagcaagattcattaagtgtgtgactgtcggagatggagcagtgggaaagacttgtatgctcatttcatataccagcaatacgtttcctacggattatgttccaacagttttcgacaacttcagcgcaaatgtggtggtcgacgggagtaccgtgaaccttggcctgtgggatactgccggtcaggaagattataataggcttaggcctttgagttacagaggagcagatgtcttcttattagcattttcccttataagcaaggccagttacgagaatattcacaaaaagtggcttccggagctgaaacattatgctcctggcatccccattgtgctcgtcggaacaaaattagatttgagggatgacaagcagttcttgaaggatcatccaggagcagcttctataacaactgctcagggagaagaattaaggaaaatgattggagctgttaggtacttagagtgcagctccaaaacccaacagaatgtgaaggcagtgtttgatacagcgataagggtagctttgaggccaccaaaggcaaagaaaaagataaaaccattgaagactaagagatcaagaatatgctttttcctataatatctgaacagatttcaataaataacaaacatttatatatacttgtattttgatatttttttgaatattttctacttgaaatagtggactttgcttcatcacgttattggcgagagtattgtcgaatcatgttaccattattcgggagaaatttgtaaaatagtagtaatttggcaagaaaattgaggattgatattttttccccata

SEQ ID NO: 134 - protein, 201 aa, Arabidopsis thaliana (mouse-ear cress)
MSTARFIKCVTVGDGAVGKTCMLISYTSNTFPTDYVPTVFDNFSANVVVDGSTVNLGLWDTAGQEDYNRLRPLSYRGADVFLLAFSLISKASYENIHKKWLPELKHYAPGIPIVLVGTKLDLRDDKQFLKDHPGAASITTAQGEELRKMIGAVRYLECSSKTQQNVKAVFDTAIRVALRPPKAKKKIKPLKTKRSRICFFL

SEQ ID NO: 135 - DNA, 784 bp, Arabidopsis thaliana (mouse-ear cress)
  CDS (1)..(591)
atgagtgcttcgaggtttataaagtgtgtcaccgtcggcgatggtgccgtcggaaaaacttgtatgctgatttcttacacaagcaacactttccctacggactatgttccaactgttttcgacaacttcagtgctaatgtggttgtagatgggaacacggtgaatcttggattgtgggatacagctggtcaagaagactataacaggttaagaccgttgagttaccgtggtgccgatgtcttcattcttgcattctcgcttattagcaaagctagctacgagaatgtagccaagaagtggattcctgagcttaggcattatgcccctggtgttcctataatcctcgttggaacgaaactcgatcttcgagatgacaagcaattcttcatagaccatcctggtgcagtgcctattactacaaaccagggagaggaactaaagaaactgataggatcaccaatctacattgaatgtagttcaaagactcagcagaatgtgaaagcagtctttgacgcagccataaaagtggtgcttcagccaccgaaacagaagaagaagaaaaagaacaagaaccgctgcgtgttcttgtgatcgaacatctcttaaaacgaaaaaaggtttaggtaacaaaagaagctgaaggaaaacgaacacctgcaacattgtatagttgttgaatccggcttgtttcggtctttactcttctttttgctggtgaatctaatgagtgaactgaggccaagaggaggattctgggtaagagaaggggatgtgttcttttctt

SEQ ID NO: 136 - protein, 196 aa, Arabidopsis thaliana (mouse-ear cress)
MSASRFIKCVTVGDGAVGKTCMLISYTSNTFPTDYVPTVFDNFSANVVVDGNTVNLGLWDTAGQEDYNRLRPLSYRGADVFILAFSLISKASYENVAKKWIPELRHYAPGVPIILVGTKLDLRDDKQFFIDHPGAVPITTNQGEELKKLIGSPIYIECSSKTQQNVKAVFDAAIKVVLQPPKQKKKKKNKNRCVFL

SEQ ID NO: 137 - DNA, 679 bp, Arabidopsis thaliana (mouse-ear cress)
  CDS (1)..(648)
atggcttcaagtgcttcaaagttcatcaagtgtgtgactgttggtgatggtgctgttggtaaaacctgtatgctcatctgctacaccagcaataaattccccactgactacataccaacagtttttgacaactttagtgcaaatgttgttgttgaaggcaccactgtcaatttggggctttgggacactgctgggcaagaagactataacagattaaggcctttaagttacaggggagcagatgttttcgtcttgtctttctcattagtcagccgagctagctacgagaatgtttttaaaaagtggatccctgaactccaacactttgctccaggagttccccttgtccttgttggtaccaaattagatcttcgtgaagataagcattatttggctgatcatcctggactatcccctgtaactactgcacagggagaggagttgcgtaagctaattggtgcgacgtattacattgagtgtagttcaaaaactcaacagaatgtgaaagcagtttttgattctgcgataaaggaagtgatcaaacctctggttaaacaaaaggagaagactaagaagaagaagaagcaaaagtcgaatcacggctgtttatcaaatgttctgtgtgggaggatagtgactcggcattgatgacgatgacccaactcagtctgatgatttt

SEQ ID NO: 138 - protein, 215 aa, Arabidopsis thaliana (mouse-ear cress)
MASSASKFIKCVTVGDGAVGKTCMLICYTSNKFPTDYIPTVFDNFSANVVVEGTTVNLGLWDTAGQEDYNRLRPLSYRGADVFVLSFSLVSRASYENVFKKWIPELQHFAPGVPLVLVGTKLDLREDKHYLADHPGLSPVTTAQGEELRKLIGATYYIECSSKTQQNVKAVFDSAIKEVIKPLVKQKEKTKKKKKQKSNHGCLSNVLCGRIVTRH

SEQ ID NO: 139 - DNA, 630 bp, Saccharomyces cerevisiae
  CDS (1)..(630)
atgtcacaacaagttggtaacagtatcagaagaaagctggtaatcgttggtgatggtgcctgtggtaagacatgtttattaatcgtcttttccaagggccaatttccagaagtctacgtaccaactgtctttgaaaactatgtagcagatgttgaagttgatgggcgtcgtgtagagctagcgctatgggataccgctggtcaagaagattatgatagactaagaccattgtcatacccagactccaatgtcgtattaatttgtttctctatcgatcttccagattctttagagaatgtacaagaaaaatggattgccgaagtattacatttctgtcaaggtgtgccaattattcttgttggttgtaaagtggatttgagaaacgacccacaaaccattgaacaattaagacaagaaggtcaacaacccgttacatcacaggagggacaatctgtagcagaccagattggcgcaaccggatactacgaatgttcggccaagactggttatggtgtcagagaagtgtttgaggccgccactagagcttcattgatgggtaaatctaaaacgaatggtaaagctaagaagaacactactgaaaagaagaagaagaagtgtgtcttgttatag

SEQ ID NO: 140 - protein, 209 aa, Saccharomyces cerevisiae
MSQQVGNSIRRKLVIVGDGACGKTCLLIVFSKGQFPEVYVPTVFENYVADVEVDGRRVELALWDTAGQEDYDRLRPLSYPDSNVVLICFSIDLPDSLENVQEKWIAEVLHFCQGVPIILVGCKVDLRNDPQTIEQLRQEGQQPVTSQEGQSVADQIGATGYYECSAKTGYGVREVFEAATRASLMGKSKTNGKAKKNTTEKKKKKCVLL

SEQ ID NO: 141 - DNA, 987 bp, Aplysia californica (California sea hare)
  CDS (14)..(592)
  MISC_FEATURE (980)..(981): n is a, t, c, or g
ccaagtgccaaccatggcagcgatacgaaagaagcttgttatagtcggagatggtgcgtgtggtaaaacatgtctacttattgtcttcagcaaagaccagttccctgaagtttacgtgccaacagtttttgaaaattatgtagcagacattgaagttgatggcaaacaggttgagctagctctgtgggacacagcgggacaagaggactatgacagactgaggccgctgtcttaccctgacacagatgtcatcctcatgtgtttctctatagacagtccagacagtctggagaacataccggagaagtggacgcctgaggttcgtcacttttgtccaaatgttcctataatacttgtgggtaacaaaaaggatcttcgcaacgatgaaagtaccaaacgtgagctcatgaaaatgaaacaggaaccagtgagaccagaggatgggcgcgccatggctgagaaaatcaacgcctactcttatcttgagtgctctgctaaaaccaaggagggcgtgagggatgtgtttgagacagctaccagagctgcgctgcaagtgaaaaagaagaagaagggtggatgtgttgtattgtgaataagtcgctgttttcttcaattccccacaacagggctggtgaaaggaggactgcatgaaattttgtcttttgaagatattccttttaaaattattttttttaaaataccaattttcaacttaagattgttcaattataattagtgcaaaaagacggatgcttcccgactgaaacacaagaaaggccatatcagagtggcatatgatcacagtcatattttgtggcttgtgtgattgcatatatatttaagaacaaatataagcgtcaactatctatggctggagaatgaggtaatggaaatgttttatttgagtaaattcctcatctgcaaaaagtttgtactacagttgagtaaaatttcaagcattgtctcctttacaaattgtnngccccc

SEQ ID NO: 142 - protein, 192 aa, Aplysia californica (California sea hare)
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVRHFCPNVPIILVGNKKDLRNDESTKRELMKMKQEPVRPEDGRAMAEKINAYSYLECSAKTKEGVRDVFETATRAALQVKKKKKGGCVVL

SEQ ID NO: 143 - DNA, 579 bp, Homo sapiens (man)
  CDS (1)..(579)
atgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaa

SEQ ID NO: 144 - protein, 192 aa, Homo sapiens (man)
MQAIKCVVVGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 145 - DNA, 642 bp, Homo sapiens (man)
  CDS (1)..(642)
atgcccggagccggccgcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtga

SEQ ID NO: 146 - protein, 213 aa, Homo sapiens (man)
MPGAGRSSMAHGPGALMLKCVVVGDGAVGKTCLLMSYANDAFPEEYVPTVFDHYAVSVTVGGKQYLLGLYDTAGQEDYDRLRPLSYPMTDVFLICFSVVNPASFQNVKEEWVPELKEYAPNVPFLLIGTQIDLRDDPKTLARLNDMKEKPICVEQGQKLAKEIGACCYVECSALTQKGLKTVFDEAIIAILTPKKHTVKKRIGSRCINCCLIT

SEQ ID NO: 147 - DNA, 582 bp, Homo sapiens (man)
  CDS (1)..(582)
atggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctga

SEQ ID NO: 148 - protein, 193 aa, Homo sapiens (man)
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPIL

SEQ ID NO: 149 - DNA, 576 bp, Homo sapiens (man)
  CDS (1)..(576)
atgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagagccaggcgcccatcacaccgcagcagggccaggcactcgcgaaacagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtga

SEQ ID NO: 150 - protein, 191 aa, Homo sapiens (man)
MQSIKCVVVGDGAVGKTCLLICYTTNAFPKEYIPTVFDNYSAQSAVDGRTVNLNLWDTAGQEEYDRLRTLSYPQTNVFVICFSIASPPSYENVRHKWHPEVCHHCPDVPILLVGTKKDLRAQPDTLRRLKEQSQAPITPQQGQALAKQIHAVRYLECSALQQDGVKEVFAEAVRAVLNPTPIKRGRSCILL

SEQ ID NO: 151 - DNA, 2292 bp, Homo sapiens
  CDS (1)..(2292)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccctcgagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagcttccggaggtggaaccggtggtggaggtaccatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtccgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacttgagcacccagtccgccctgagcaaagaccccaacgagaagcgcgatcacatggtcctgctggagttcgtgaccgccgccgggatcactctcggcatggacgagctgggccgctctagaaagatgagcaaagatggtaaaaagaagaaaaagaagtcaaagacaaagtgtgtaattatgtaa

SEQ ID NO: 152 - protein, 763 aa, Homo sapiens
MVSKGEELFTGVVPILVELDGDVNGHKFSVSGEGEGDATYGKLTLKFICTTGKLPVPWPTLVTTLGYGLQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSALSKDPNEKRDHMVLLEFVTAALEKEKERPEISLPSDFEHTIHVGFDAVTGEFTGMPEQWARLLQTSNITKSEQKKNPQAVLDVLEFYNSKKTSNSQKYMSFTDKSASGGGTGGGGTMQAIKCVVVGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVRGRMVSKGEELFTGVVPILVELDGDVNGHKFSVSGEGEGDATYGKLTLKFICTTGKLPVPWPTLVTTLTWGVQCFSRYPDHMKQHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITLGMDELGRSRKMSKDGKKKKKKSKTKCVIM

SEQ ID NO: 153 - DNA, 2289 bp, Homo sapiens
  CDS (1)..(2289)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcaccgccgacaagcagaagaacggcatcaaggccaacttcaagatccgccacaacatcgaggacggcggcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccctcgagaaagagaaagagcggccagagatttctctcccttcagattttgaacacacaattcatgtcggttttgatgctgtcacaggggagtttacgggaatgccagagcagtgggcccgcttgcttcagacatcaaatatcactaagtcggagcagaagaaaaacccgcaggctgttctggatgtgttggagttttacaactcgaagaagacatccaacagccagaaatacatgagctttacagataagtcagcttccggaggtggaaccggtggtggaggtacccagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagagaggtctgaagaatgtgtttgatgaggctatcctagctgccggcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacttgagcacccagtccgccctgagcaaagaccccaacgagaagcgcgatcacatggtcctgctggagttcgtgaccgccgccgggatcactctcggcatggacgagctgggccgctctagaaagatgagcaaagatggtaaaaagaagaaaaagaagtcaaagacaaagtgtgtaattatgtaa

SEQ ID NO: 154 - protein, 762 aa, Homo sapiens
MVSKGEELFTGVVPILVELDGDVNGHKFSVSGEGEGDATYGKLTLKFICTTGKLPVPWPTLVTTLGYGLQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSALSKDPNEKRDHMVLLEFVTAALEKEKERPEISLPSDFEHTIHVGFDAVTGEFTGMPEQWARLLQTSNITKSEQKKNPQAVLDVLEFYNSKKTSNSQKYMSFTDKSASGGGTGGGGTQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQRGLKNVFDEAILAAGGRMVSKGEELFTGVVPILVELDGDVNGHKFSVSGEGEGDATYGKLTLKFICTTGKLPVPWPTLVTTLTWGVQCFSRYPDHMKQHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITLGMDELGRSRKMSKDGKKKKKKSKTKCVIM

SEQ ID NO: 155 - DNA, 1139 bp, Arabidopsis thaliana
  CDS (66)..(875)
tcgacccacgcgtccggtctagtcttttatattgtagataatatttctatctggacataacaacaatggcagatgcaaacgaagtagtggaatgggccaacaatttaaagtgggataaatatgctggaaataaagaaattgttgatggattggccgctttgagacaaaaaatcacagctttggacggcgctgaaggaggctctggtggcaatcaaagagttaaattagtagttgtcggtgatggtgccgtcggcaaaacatctctgttgatttcattcgctgaaaacaaattccctgaggattacgtccctacagtcttcgaaaactacacttctaaaatcactcgcgacgatggtacacttgttctgttgcatttgtgggatacagccggtcaagaggactacgaccgattgagacctttgagttatcctggcgctgatgtcatcctgctctgtttctccaccgtcactgcctcgtcattcgcctccattaaagaaaagtggtaccccgaagtcaaccactacgtgcccgatgctccttatattttggtcggcaccaagctcgacttgcgtgaggctggtctgcccgatccctccactggtgagtcagatcccgtcacccccgagaaggctgaggagatgcgaaagcaaatcaaagcgttgaagtatattgaagtctctgccaagacacgaaagaacttgcagactctgttttcagaagccgtggacattgtcttggctgaacgacgcgcacacgagcctcccaagcccaccgctgcttcatcgacgaacggcactaacggcactaagactgagcacactcctcgcgaagagcccatccgaaagaagaaggagcgtcgctgcttgttgatgtaagagccctgtgattggtcactctaacatcgactcgagatctgcactattactattttatttgtcgtttttaactttatttaatcaaaaaaccctttcaaccaataagccacgataagagtcgtgcagtcaaatttattttggtagcccttggatctgctatcaagattttcttgtattatcgacttgtaattaataggactgtagcgatatcgtgcttctttatttatttcaataaaaacaaaaaattaaaaaaaaaaaaaaaaa

SEQ ID NO: 156 - protein, 269 aa, Arabidopsis thaliana
MADANEVVEWANNLKWDKYAGNKEIVDGLAALRQKITALDGAEGGSGGNQRVKLVVVGDGAVGKTSLLISFAENKFPEDYVPTVFENYTSKITRDDGTLVLLHLWDTAGQEDYDRLRPLSYPGADVILLCFSTVTASSFASIKEKWYPEVNHYVPDAPYILVGTKLDLREAGLPDPSTGESDPVTPEKAEEMRKQIKALKYIEVSAKTRKNLQTLFSEAVDIVLAERRAHEPPKPTAASSTNGTNGTKTEHTPREEPIRKKKERRCLLM

SEQ ID NO: 157 - DNA, 582 bp, Caenorhabditis elegans
  CDS (1)..(582)
atgcaagcaatcaaatgtgtcgtcgttggtgacggagccgtcggtaagacgtgtctcctgctatcgtacactacaaacgcttttcccggagaatatattctaacggtgttcgacacctactcaacaaatgtgatggtcgacggacggccaataaatctcagcctatgggacacagctggacaggaagattacgatcaattccgccaacatttccacaaaaaatttccacaaacagacgtatttctcgtatgctttgcattgaataataatgttcgtgcaaaatggtatccagaagtatcacatcattgcccaaatacaccgattattttggttggaacgaaagctgatttgcgcgaggatcgagatactgttgaacggctccgcgaaagccggctccaaccagtgagccacacccagggttacgtgatggcaaaggaaatcaaggcggtcaagtacctggaatgctcggcgcttacccaaattggattgaaacaagttttcgatgaggcaattcgtactgggctcaccccgccacaaacaccacaaacgagagccaaaaagagcaattgcacggtgctttaa

SEQ ID NO: 158 - protein, 193 aa, Caenorhabditis elegans
MQAIKCVVVGDGAVGKTCLLLSYTTNAFPGEYILTVFDTYSTNVMVDGRPINLSLWDTAGQEDYDQFRQHFHKKFPQTDVFLVCFALNNNVRAKWYPEVSHHCPNTPIILVGTKADLREDRDTVERLRESRLQPVSHTQGYVMAKEIKAVKYLECSALTQIGLKQVFDEAIRTGLTPPQTPQTRAKKSNCTVL

SEQ ID NO: 159 - DNA, 576 bp, Ciona savignyi
  CDS (1)..(576)
atgcaaactataaagtgtgtagttgttggagatggtgctgtgggtaaaacctgtttgctaatatcctataccacaaacaagtttccacaagaatatgttccaacggtcttcgacaactatgccgtcactgttatgatcggaggggaaccatacacattgggtttatttgatactgcaggccaggaagattatgacaggttaaggcctctcagttatccacaaactgatgtgtttttggtttgtttttctgttgtatcaccgtcatcatatgaaaatataaaagaaaagtgggtcccggaaatcacccatcattgtccaaagacgccatttttattggttggaacccaggttgatttgcgagatgatgctgcaacaattgaaaaactttcaaagaacaaacagaaagctataactccagatttgggtgataaactggcaagagagttaaaagcagtaaaatatgtcgagtgctctgcccttactcaaaaaggattaaagaatgtatttgatgaagctattttagctgctttagagccaccggagcctaaaagacgtcgccgatgtcaaattttgtga

SEQ ID NO: 160 - protein, 191 aa, Ciona savignyi
MQTIKCVVVGDGAVGKTCLLISYTTNKFPQEYVPTVFDNYAVTVMIGGEPYTLGLFDTAGQEDYDRLRPLSYPQTDVFLVCFSVVSPSSYENIKEKWVPEITHHCPKTPFLLVGTQVDLRDDAATIEKLSKNKQKAITPDLGDKLARELKAVKYVECSALTQKGLKNVFDEAILAALEPPEPKRRRRCQIL

SEQ ID NO: 161 - DNA, 757 bp, Cryptococcus neoformans
  CDS (9)..(602)
cacacaccatgtccggagaaatcaggagaaagctcgttattgtcggcgacggtgcttgtggtaagacatgtcttcttatcgtgttcagcaagggcatgttccccgaggtgtacgtgcccaccgtctttgaaaactatgtcgccgatgtagaggtggacgggaagaaggtcgagctggcgttgtgggatactgctggacaggaggactatgaccgactccgacctctttcttaccccgactcccatgtcattctcatctgtttcgctattgactcccccgactcgcttgacaatgttcaagaaaagtggatttccgaggtccttcacttctgtcagggtctccccatcgtcctcgtggcgtgcaagaaggatctccgcgacgatggcaagactatccaggaccttgccaggatgaaccagaggcctgtttcccgggccgagggtatggccgttgcccaaaagattggggcgcagggctacgtcgagtgcagtgccaagacgggcgagggtgtcagggaagtgttccagactgctaccaggcatgctctccagagcaaaaagtccaagtctggcagagggaagaagggttgtgtggtgctttagggctctataaatcgagttgtactttatcttgttcgtcgctggcgtctttatacctctttctcttcacgccattctcacgccttggcccaagtgtttggggcttattctctcttttacttgctgtgatttgatgaatcgatgagtagttatgcccg

SEQ ID NO: 162 - protein, 197 aa, Cryptococcus neoformans
MSGEIRRKLVIVGDGACGKTCLLIVFSKGMFPEVYVPTVFENYVADVEVDGKKVELALWDTAGQEDYDRLRPLSYPDSHVILICFAIDSPDSLDNVQEKWISEVLHFCQGLPIVLVACKKDLRDDGKTIQDLARMNQRPVSRAEGMAVAQKIGAQGYVECSAKTGEGVREVFQTATRHALQSKKSKSGRGKKGCVVL

SEQ ID NO: 163 - DNA, 626 bp, Gallus gallus
  CDS (27)..(605)
tctcggcggcgcgccatcgcgggcagatgcaggcgatcaagtgtgtggtggtgggcgacggagctgtagggaagacctgcttgctgatcagttacaccacgaatgcctttcctggagagtacatccccactgtatttgataactattctgccaatgtcatggtagatgggaagccagtgaatctaggcctctgggatacagcaggacaagaggattatgaccgactgcggcctctttcctacccacagacagatgttttcttgatttgcttctccctcgtgagtccagcctcctttgagaatgtcagagccaagtggtaccctgaggtccgacaccactgcccaaatacacctatcatcttggtgggcaccaagctggacttaagggatgataaggacaccattgaaaggttacgtgataagaaactggctcccatcacctacccccaaggtttggccatggctcgggagattggctcggtaaagtaccttgagtgctctgccctgacacagcggggcttgaagacggtgtttgatgaagccatccgggctgtgctctgcccaccgcccgtgaagaagcctggcaaaaagtgcaccgtgttctgagggctgtggcctaggtgctgg

SEQ ID NO: 164 - protein, 192 aa, Gallus gallus
MQAIKCVVVGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPNTPIILVGTKLDLRDDKDTIERLRDKKLAPITYPQGLAMAREIGSVKYLECSALTQRGLKTVFDEAIRAVLCPPPVKKPGKKCTVF

SEQ ID NO: 165 - DNA, 731 bp, Gallus gallus
  CDS (48)..(638)
cggccatcgtcctgctgcacggcaaggccagcttggcgagcctggccatggccgccatccgcaagaagctggtggtggtgggagacggcgcctgtggcaagacctgcctcctcatcgtcttcagcaaggacgagttccccgaggtttacgtgcccaccgtctttgagaactacgtggccgacatcgaggtggacggcaagcaggtggagctggcgctgtgggacacggccggccaggaggactacgaccgcctgcgccctctctcctacccagacacggacgtgatcctcatgtgcttctcagtggacagcccggactcgctggagaacatcccggagaagtgggtgcccgaagtcaagcacttctgccccaacgtccccatcatcctggtggccaacaagaaagacctgcgcaacgacgagcacgtgcgtaacgagctggcccgcatgaagcaggagccggtgcgcactgaggatggccgcgccatggccatccgcatccaggcctacgactacctggagtgctcggccaagaccaaggagggtgtgcgggaggtctttgagacggccacccgggcggccttgcagaagcgctacggcactcagaacggctgcatcaattgctgcaaggtcctatagggcccggctggagccggcgctgggcacggctctgggtcacctgttggcaggcggagaggagctggggcacgcatgcacacagcatctgcctgt

SEQ ID NO: 166 - protein, 196 aa, Gallus gallus
MAAIRKKLVVVGDGACGKTCLLIVFSKDEFPEVYVPTVFENYVADIEVDGKQVELALWDTAGQEDYDRLRPLSYPDTDVILMCFSVDSPDSLENIPEKWVPEVKHFCPNVPIILVANKKDLRNDEHVRNELARMKQEPVRTEDGRAMAIRIQAYDYLECSAKTKEGVREVFETATRAALQKRYGTQNGCINCCKVL

SEQ ID NO: 167 - DNA, 883 bp, Hemicentrotus pulcherrimus
  CDS (61)..(639)
cgggtgtaatctgcctcttcctggtactattttatgaaatttgtgtgaaaacctaagacaatggctgctataaggaaaaagttggttatcgtaggagatggtgcttgtgggaagacgtgtctgctcatagtatttagcaaagaccagttccctgaagtctatgtcccaacagtttttgagaactatgtagctgatatagaagtagacggtaaacaggttgagttggcattatgggatacagcaggtcaggaagactacgacagactgagaccgctctcatatccagacacagacgttatactcatgtgcttttcaatcgacaacccagacagtttagaaaccatcccagaaaaatggacaccagaggtgaagcacttttgccctaatgtacctgtcatcttggtcggcaacaagaaagatcttcgaaatgacgatgccacaaaacgggaactgagtaagatgaagcaggaaccggtgaaatataatgatgcccagaccatgtcagataagatcaacgcctacaaatacctagaatgctcagccaagtctaacgatggtgtcagggaagtgtttgagacagcaaccagagcagcactacaagttaaaaagaagaagtcatcaaaatgcagcctcttgtaagagaagtcttcatgcaagctggcaaggcatggtagtggtcaacaagaggtcctcaaagaataatgcatttaatatacatgtatgtgtttggggaaaagagcgattatgtaatatttctggatgtgctttgaaggtcaaagacagcggtagtgccagcatactttgtttaattgctgttgtgataataagaggcaatcggcttaattttgtagttgcagatttacgaaaccacttttctttcttt

SEQ ID NO: 168 - protein, 192 aa, Hemicentrotus pulcherrimus
MAAIRKKLVIVGDGACGKTCLLIVFSKDQFPEVYVPTVFENYVADIEVDGKQVELALWDTAGQEDYDRLRPLSYPDTDVILMCFSIDNPDSLETIPEKWTPEVKHFCPNVPVILVGNKKDLRNDDATKRELSKMKQEPVKYNDAQTMSDKINAYKYLECSAKSNDGVREVFETATRAALQVKKKKSSKCSLL

SEQ ID NO: 169 - DNA, 958 bp, Arabidopsis thaliana
  CDS (146)..(742)
gtcgacccacgcgtccggagagactttcagcagctatttctttgtcttctttctctataaagaacctcactctctctctctttagtcaaaaatccccaattcgtgaacaaattagggtttttgaagtttgaagaaggagagaaagatgagtgcttcaaggtttatcaagtgtgtcactgtcggcgacggtgctgttggaaagacttgtcttctcatctcctacactagcaacactttccccacggattatgtgccaactgtgttcgataatttcagtgccaatgtgattgttgatggcaacactatcaacttgggattgtgggatactgcagggcaagaggactacaatagactaagacctttgagctatcgcggtgcagatgtcttcttacttgcattctcacttgtcagcaaagctagctatgaaaatgtttctaaaaagtgggttcctgaactgagacattatgctcctggtgttcccatcatcctcgttggaacaaagcttgatcttcgacatgataagcaattctttgccgagcaccctggtgctgtgcctatctctaccgctcagggtgaagaactaaagaagctgattggggcgcctgcttatatcgaatgcagtgcaaaaactcaacagaatgtgaaagcagtgtttgatgcggctatcaaggtcgttctccagccaccaaaaaacaagaagaagaagaagagaaaatctcagaaaggttgttctatactctgattcaacaagaagaaaggaatcaacaggagaattagagctataagtatttgttttctcctttttcataacttgtttacccaaggaatcaaaaatctgttgtttgtagtctgaaaatgacaaaagttgaagaactagtaacaagtatttgtattcttgtttgcattttgatctgtaaatataccacgaatccttgatttctctgtttcctaaaaaaaa

SEQ ID NO: 170 - protein, 198 aa, Arabidopsis thaliana
MSASRFIKCVTVGDGAVGKTCLLISYTSNTFPTDYVPTVFDNFSANVIVDGNTINLGLWDTAGQEDYNRLRPLSYRGADVFLLAFSLVSKASYENVSKKWVPELRHYAPGVPIILVGTKLDLRHDKQFFAEHPGAVPISTAQGEELKKLIGAPAYIECSAKTQQNVKAVFDAAIKVVLQPPKNKKKKKRKSQKGCSIL

SEQ ID NO: 171 - DNA, 780 bp, Anopheles gambiae str
  CDS (208)..(780)
gcggccgcaaaagcaaatgaaaagttgaactgaaacttccaagcgcacaaagtcgagccgtgaggtgttttccttgtttttccgtgttcgagtgtgtgtgtggtggttctgtgtttcgtacgtgtgcggtgcgcgtttgtgttggaggtgtttcggtttgtattttcttcgtgtttccagtttgtttttcctaggtttcgctaaaagatgtcatccggaagacctatcaaatgtgtggtggtcggcgacggcacggtggggaagacgtgcatgttgatcagctacacgaccgacagctttcccggcgaatacgtacccacggtcttcgacaactactccgccccgatggtggtggacggtgtgcaagtgtcgctcgggctgtgggatacggccgggcaggaagactacgatcggctaaggcccctgtcctacccacagacggacgtgttcctcatatgctacagtgtggccagcccgtcgtcgttcgaaaacgttacctccaaatggtatcccgagatcaagcaccactgcccggatgcgcccatcattttagtcggaaccaaaatcgatctgcgcgaggatcgggaaacgataagcttgctggcggaccagggcctttccgcgctgaagcgcgaacagggccaaaagctagcgaacaagatacgggcggtaaagtatatggaatgttcggcactaacccagcggggcctaaagcaggtgtttgacgaagcgctttgcgccacggaagagaaagagcgaatgccggtagaagaggagtag

SEQ ID NO: 172 - protein, 190 aa, Anopheles gambiae str
MSSGRPIKCVVVGDGTVGKTCMLISYTTDSFPGEYVPTVFDNYSAPMVVDGVQVSLGLWDTAGQEDYDRLRPLSYPQTDVFLICYSVASPSSFENVTSKWYPEIKHHCPDAPIILVGTKIDLREDRETISLLADQGLSALKREQGQKLANKIRAVKYMECSALTQRGLKQVFDEALCATEEKERMPVEEE

SEQ ID NO: 173 - DNA, 657 bp, Giardia lamblia ATCC 50803
  CDS (1)..(657)
atgactagtacaggaaatgaggatacagcgggtgcaaggatgatacatatcaaagccgtagtggttggagacggctcagtgggcaagacctgccttctttttgtctatgcgaataactcatttccagaggactacttgccaacagtctttgacaactattctgccaacgtcgttgttgacaacttgacgataaatattggtctctgggatactgcgggccaggaggattacgacaaattgcgacccttgagctatccaggggcgcacgtatttttgctctgctttagcgtcgtttccagcacttcgtttgcaaacatcagatccaaatggtacacagaggtcaaggagtactgtccaaacgtgccgatgatccttgtcggaacaaagtatgacctgctgtccgacgaggcttacctggccaagatgaaagagaagaaccaatccccggtgtctgatgaacgtgcagaggaagttgcaaaagagataaaggccattaagtacattagctgcagtgcccgatgccaacttcgcgtaaaggacgtgtttgatagtgcaatccgcgcggctctcaagaatatggggatgatgggtagtgggacttccaaggcaggaaagaaaaaggatggatctggaaagggaaagtgtgttatattctag

SEQ ID NO: 174 - protein, 218 aa, Giardia lamblia ATCC 50803
MTSTGNEDTAGARMIHIKAVVVGDGSVGKTCLLFVYANNSFPEDYLPTVFDNYSANVVVDNLTINIGLWDTAGQEDYDKLRPLSYPGAHVFLLCFSVVSSTSFANIRSKWYTEVKEYCPNVPMILVGTKYDLLSDEAYLAKMKEKNQSPVSDERAEEVAKEIKAIKYISCSARCQLRVKDVFDSAIRAALKNMGMMGSGTSKAGKKKDGSGKGKCVIF

SEQ ID NO: 175 - DNA, 624 bp, Neurospora crassa
  CDS (1)..(624)
atggtgacgggaactatcaagtatgccaaaacaaaccaccccttatcgagagagtgcgtagtcgtcggtgacggtgccgttggaaagacatgtctcctcatcagctatacaacgaataagttcccctcggaatatgtgccgacagttttcgacaactatgccgtcaccgtcatgatcggtgatgagccctatacgctcggcctgttcgatacagcaggacaagaagattacgaccgtttacgtccgctatcatacccccagaccgacgtcttcctcatctgcttcagcgttgcatcgcccgcctcgttcgaaaacgtgtcccagaaatgggcccccgaagtcaaccatcactgccccggcgtgcccttcctcatcgtcggaacgcagaaggatttgcgctccgacaaggaactgagggacaagcttgcccagcgcaagcagtcgatgatagagttcaagcagggagagaagcttgctcaggatcttgacgccgtcaaatacgtcgagtgcagtgcgctgacacaggaaggtctcaagaacgtgtttgacgaggccatcgttgcggcactggagccgcctcagaaaaagacaagtaaaagggacaagaagtgcttgattctgtga

SEQ ID NO: 176 - protein, 207 aa, Neurospora crassa
MVTGTIKYAKTNHPLSRECVVVGDGAVGKTCLLISYTTNKFPSEYVPTVFDNYAVTVMIGDEPYTLGLFDTAGQEDYDRLRPLSYPQTDVFLICFSVASPASFENVSQKWAPEVNHHCPGVPFLIVGTQKDLRSDKELRDKLAQRKQSMIEFKQGEKLAQDLDAVKYVECSALTQEGLKNVFDEAIVAALEPPQKKTSKRDKKCLIL

SEQ ID NO: 177 - DNA, 603 bp, Neurospora crassa
  CDS (1)..(603)
atggcatcaggcagccctcagaatgtcatccgcaggaaactcgtcattatcggcgacggtgcttgcggaaaaaccagtctactgagcgtcttcactttgggttttttcccagccacatatatccccaccgtgttcgagaattacgttaccgactgccgagtagatggcaagtcggttcaactagcgctatgggacacagccggacaagaagactatgagcgattacgaccactagcatactcaaaggcgcatgtcattctaatagggttttctgtcgacacgccagattctttggacaacgttaaacacaagtgggttactgaggccaatgaaagatgtcccaatgttcccatcattttggtgggtctcaagaaggatctcaggggagatcctgttgccatcgaagaaatgcgaaagcgatcccaacgattcgtgatggaggacgaaggccagaggatagcaaaggagattggcgctcgaaagtatctcgaatgttccagtcttaccggagaaggtgttgacgacgtattcgaggcagccacgcgagcggcgctgctaacgtttgagaagaaggaaggaagcgggtgctgtgtgattctatga

SEQ ID NO: 178 - protein, 200 aa, Neurospora crassa
MASGSPQNVIRRKLVIIGDGACGKTSLLSVFTLGFFPATYIPTVFENYVTDCRVDGKSVQLALWDTAGQEDYERLRPLAYSKAHVILIGFSVDTPDSLDNVKHKWVTEANERCPNVPIILVGLKKDLRGDPVAIEEMRKRSQRFVMEDEGQRIAKEIGARKYLECSSLTGEGVDDVFEAATRAALLTFEKKEGSGCCVIL

SEQ ID NO: 179 - DNA, 624 bp, Neurospora crassa
  CDS (1)..(624)
atgccttgcggactcggagggtcgaaaacagtgcagcgcaagctcgtcttgctcggcgatggtgcctgcggaaaaacctcactgctcaacgttttcacaagaggctatttccccactgtatacgagccgacagtcttcgagaactatgtgcacgacattttcgtcgacaatgtccatattgaactgtcattgtgggataccgccggccaggaagaatttgacaggctacgaagtctatcatacgatgacaccgacttaatcatgctttgctactctgtcgacagcaaggactcgctcgaaaacgtcgaaagcaaatggcaaggcgagattgctgaaaactgcccgggcgtcaagattgtcttggtcgcgttgaagtgcgacctgcgcgaggcgaccgaggacgaagaggatggcggagccaacgaggacggtgctcaacgtgagaagaagccaatgatcagctacgaccagggcctggaagtggctcgccggatcaaggcccttcgatatctcgaatgctccgccatgcgaaaccggggagtcaacgaagccttcaccgaagcagcgcgtgtcgctttgtcagtgaagaaggaccgggaggagtcgaagtgcgtggtcatgtaa

SEQ ID NO: 180 - protein, 207 aa, Neurospora crassa
MPCGLGGSKTVQRKLVLLGDGACGKTSLLNVFTRGYFPTVYEPTVFENYVHDIFVDNVHIELSLWDTAGQEEFDRLRSLSYDDTDLIMLCYSVDSKDSLENVESKWQGEIAENCPGVKIVLVALKCDLREATEDEEDGGANEDGAQREKKPMISYDQGLEVARRIKALRYLECSAMRNRGVNEAFTEAARVALSVKKDREESKCVVM

SEQ ID NO: 181 - DNA, 645 bp, Gallus gallus
  CDS (1)..(645)
atgcccgggggagggcgggctccggccatggcccatggcagcgccgcggtcatgctgaagtgcgtggtggtgggggacggcgccgtgggcaagacgtgcctgctgatgagctacgccaacgacgccttccctgaggagtacgtgcccaccgtcttcgaccactacgcagtcagcgttaccgtggagggcaagcagtacctgctggggctctacgacaccgccgggcaggaagactatgaccgtctgagacctttatcttatcctatgaccgatgtcttccttatctgcttctcagtggtaaaccctgcttcatttcaaaacgtgaaggaagaatgggtaccggagttgaaggaatatgcacctaatgttccttttttactagtaggaacacagattgatcttcgtgatgaccccaaaactctggcaagattgaatgatatgaaagagaagcctttatctgtggaacaaggacagaaattagcaaaagagataggagcctactgctatgtggagtgttcagctttaacacagaaaggactgaagactgtttttgatgaagctattatagccattctaactccaaagaaacacacggtgaagaagagaataggttcgagatgcataaactgctgtttgatcacgtga

SEQ ID NO: 182 - protein, 214 aa, Gallus gallus
MPGGGRAPAMAHGSAAVMLKCVVVGDGAVGKTCLLMSYANDAFPEEYVPTVFDHYAVSVTVEGKQYLLGLYDTAGQEDYDRLRPLSYPMTDVFLICFSVVNPASFQNVKEEWVPELKEYAPNVPFLLVGTQIDLRDDPKTLARLNDMKEKPLSVEQGQKLAKEIGAYCYVECSALTQKGLKTVFDEAIIAILTPKKHTVKKRIGSRCINCCLIT

SEQ ID NO: 183 - DNA, 582 bp, Brachydanio rerio
  CDS (1)..(582)
atggctgcaattcgaaagaaacttgtcatagtcggtgatggagcctgtggaaagacctgtttgctcatagttttcagtaaagatcagtttcccgaagtctacgtgccgacagtcttcgagaactacgttgcagatatcgaggtcgattcaaaacaggttgagcttgccttatgggatactgctggacaggaggactatgatcggttaagacccctctcctatcctgacacagatgttattctcatgtgcttctccatcgacagtcctgatagcttggaaaatatcccagaaaaatggacaccagaggtgaagcatttctgtcccaatgttcccatcatcctcgtgggtaacaaaaaggatctccggaatgatgagcacacacgaagggaacttgccaaaatgaaacaggagccggtaaagccagaagaagggcgagacatggccaaccgaatcaatgcctttggttatctagagtgttcggccaaaacaaaagatggcgtgagagaagtctttgaaatggccaccagggcggcgctgcaagccagaaaacgtggtaaaaagagcggctgcctgctgttataa

SEQ ID NO: 184 - protein, 193 aa, Brachydanio rerio
MAAIRKKLVIVGDGACGKTCLLIVFSKDQFPEVYVPTVFENYVADIEVDSKQVELALWDTAGQEDYDRLRPLSYPDTDVILMCFSIDSPDSLENIPEKWTPEVKHFCPNVPIILVGNKKDLRNDEHTRRELAKMKQEPVKPEEGRDMANRINAFGYLECSAKTKDGVREVFEMATRAALQARKRGKKSGCLLL

SEQ ID NO: 185 - DNA, 582 bp, Brachydanio rerio
  CDS (1)..(582)
atggcggctatcaggaaaaagctggtgatcgtgggagatggagcatgtgggaagacctgtctactcatagtgttcagcaaagaccagtttccagaagtctacgtgcctactgtgttcgagaactacattgctgacattgaagtcgacagcaaacaggtggagctggcattgtgggacacagcaggacaggaggactatgaccgtctcagacctctgtcttacccagacacagatgtcatcctcatgtgcttctccatagacagtcccgacagtttagagaatatcccagaaaagtggacgccggaggtaaagcacttctgccccaacgttcccataatcctggtgggcaataagagagatctgcgtactgatgagaacacacggagggagctgactaagatgaagcaggagccagttaaaatagaagagggcagggacatggctaaccgcattagcgccttcggctacctggaatgctcagctaagactaaggatggcgtgagggaagtttttgaaatggccaccagagcggcgctgcaggttcgcaagaggaagaagaggagcgggtgctcactgttgtga

SEQ ID NO: 186 - protein, 193 aa, Brachydanio rerio
MAAIRKKLVIVGDGACGKTCLLIVFSKDQFPEVYVPTVFENYIADIEVDSKQVELALWDTAGQEDYDRLRPLSYPDTDVILMCFSIDSPDSLENIPEKWTPEVKHFCPNVPIILVGNKRDLRTDENTRRELTKMKQEPVKIEEGRDMANRISAFGYLECSAKTKDGVREVFEMATRAALQVRKRKKRSGCSLL

SEQ ID NO: 187 - DNA, 806 bp, Ciona intestinalis
  CDS (1)..(750)
atggaaaggatacccaatgacgtcaaaggtgctttccccgagcagcaacccaaaattaaatgtgttatagttggggatggtggatgcggtaaaacttcaatgctggttgtatatactgaaggcgaattccctgaagtgtacacgcccacggtgtttgaaaattacagcagagaggtggaattaaatcgaaagaaggcggtgctaacattgtgggatacggcgggtcaggaagattatgaccggcttcgacctctctcttacaacaacgcagacatcataatcatctgctatgacgtcacaaacctttcaagcttccagaacgtagaaatccgatggtcgccagaaatccgccatttttgcccccacacgcctacgatgctggttgcgtgtaaaactgacctgaggtctcaggtgaactcggattcaatttcaaactctatgactcgatctgcttccatggcaaccacattaacaacaactggagtagatttaacagaaatgacgtcatctacgttaagtgtaaattcggtacgcgcagaagatggaacagacagacacgatgatcaagcaatagttacaacagaaatgggcgagaagatgtcgaaacacatcaacgtcaatcattttgttgaatgttctgccaaggatggcacaaacattgaacaagtatttaaacttgcaatcgaatgcgtcattaaacgtgaagcaaaagtcggtccaaaaaactgctgctgttgtttgctattgtgatacgctgttacgtaaataaattgactgtgtaggaaatgcctaacaaatcaatcgcg

SEQ ID NO: 188 - protein, 249 aa, Ciona intestinalis
MERIPNDVKGAFPEQQPKIKCVIVGDGGCGKTSMLVVYTEGEFPEVYTPTVFENYSREVELNRKKAVLTLWDTAGQEDYDRLRPLSYNNADIIIICYDVTNLSSFQNVEIRWSPEIRHFCPHTPTMLVACKTDLRSQVNSDSISNSMTRSASMATTLTTTGVDLTEMTSSTLSVNSVRAEDGTDRHDDQAIVTTEMGEKMSKHINVNHFVECSAKDGTNIEQVFKLAIECVIKREAKVGPKNCCCCLLL

SEQ ID NO: 189 - DNA, 726 bp, Ciona intestinalis
  CDS (14)..(598)
ttgagttcatgaaatgcagtctataaaattggtcgtggtgggcgatggtgccgtgggaaaaacgtgtctacttatcagctacacggcgaatgcctttccaagggagtatgttccgaccgtgtttgaaaactacatggcaaatatcacggtcaacaatcagcaaatttgcttaagtctttgggataccgctggtcaagaggattttgacaggttgagaccgctttcatatccagacaccgatgtctttgttctctgcttctcgataatttctccaacctcctttgaaaatctccagcacaaatggttgcccgagttacgagaacattgtcctaatgtgcccatcctgctagtgggtacgaagcttgacttgagagaagacaccgaaattctacaacagctttcctcgaaaaatctaaaaccaataacaccagaagaaggggcgaaaatggcgaaagatattaaagcagttaaatatttagagtgttctgctctaactcaggagtgtctcagccaagtatttgatgacgctgttattgcagtgctaaacccatcacacttttcaagtaacaatgacaacagctgttgtaagatcgtttaaatttacatctcgttgtttacttacagtgttatgtgtattaacattaccgtgatacacacacgagttcatagggttaaaaacgagagttatattttctttaaaattagataaacactcattcccgtcaa

SEQ ID NO: 190 - protein, 194 aa, Ciona intestinalis
MQSIKLVVVGDGAVGKTCLLISYTANAFPREYVPTVFENYMANITVNNQQICLSLWDTAGQEDFDRLRPLSYPDTDVFVLCFSIISPTSFENLQHKWLPELREHCPNVPILLVGTKLDLREDTEILQQLSSKNLKPITPEEGAKMAKDIKAVKYLECSALTQECLSQVFDDAVIAVLNPSHFSSNNDNSCCKIV

SEQ ID NO: 191 - DNA, 827 bp, Ciona intestinalis
  CDS (34)..(615)
atttgtaaggacgagaaccaacacaacaaaataatgcagtccgtgaaatgtgttgtggttggagatggagctgttggtaaaacctgtttgctgatcagctacacaaccaatgctttccctggagaatatattcccactgtgtttgaaagctatgctgcaaatgttgtggtggatgggaacccagtgaacatcggtttatgggacacagctggccaggaagattacgataaacttcgaccgctatcatacccacagtcagatgtctttgtcatgtgcttctcgttggtaaacccaacatcttatgaaaacattgcagaaaaatggtatccggaagttcatgaacactgtcccgacatccccattgtactcgttgggacaaaactggatttacgtgaagacccagaaacactcaaaacgttgggtgagagaaatcttgttccagttaccaaaacccagggcctccagttggcgaaaaaagttggggcaaagaaatattttgagtgctcggcgcttactcgtgaaaacttagacgaactctttcttgaagcaatgcgcaatgccctgaaaggaccggacaaaattgtaaaagagaaaccaaattgtcaaattatctaatcagcatttaagaattttgagttaacgctcgaataattgttcagtatacaactgtataccaaagtccataaaaataaaaattaaaactatagactttgctgtacacattatacatgtcgttaccgcatgtggtgtagcttaaacgattgtgcaatacctttatattaaaggttaatgttttacagtcgtgagtaactggaactctctgcgta

SEQ ID NO: 192 - protein, 193 aa, Ciona intestinalis
MQSVKCVVVGDGAVGKTCLLISYTTNAFPGEYIPTVFESYAANVVVDGNPVNIGLWDTAGQEDYDKLRPLSYPQSDVFVMCFSLVNPTSYENIAEKWYPEVHEHCPDIPIVLVGTKLDLREDPETLKTLGERNLVPVTKTQGLQLAKKVGAKKYFECSALTRENLDELFLEAMRNALKGPDKIVKEKPNCQII

SEQ ID NO: 193 - DNA, 718 bp, Ciona intestinalis
  CDS (6)..(584)
aagatatgcaagcgataaagtgcgttgtggttggagatggagctgttggtaaaacctgtttgctgatcagctacacaactaacgctttccctggagaatatattcccactgtgtttgataactactctgccaatgtcatggtagatggccgccctgtcaacttgggattatgggatacagcaggacaggaggattatgacagactccgacctctctcctacccacaaaccgatgtttttctcatttgtttctctgtggcttctcccgcttcctacgaaaacgtgcgcgcaaagtggcacccggaggtcgcacaccactgcccggaaacgcccgtacttctcgtgggaacaaaacttgatttacgtgacgatgcggacactgtgaacaagctagctgagaaaaagctctccaccattactactacccaaggtttacaaatggcgaaggaactgggggcggttaaataccaagagtgctctgctctgacgcaaaaggggctgaaaaatgttttcgacgaagcgattcgggcggttcttaacccaacaagaagagtcgtccgaacgaagaactgcgaaattctatgattacattgacatgtagagcggcctcgaacgtttacaataatttggaattatgttcctatttaataaatggagttcggtggctttatatattctctcttatcgttttaagcattttaaaatcgtcgctaccgtgt

SEQ ID NO: 194 - protein, 192 aa, Ciona intestinalis
MQAIKCVVVGDGAVGKTCLLISYTTNAFPGEYIPTVFDNYSANVMVDGRPVNLGLWDTAGQEDYDRLRPLSYPQTDVFLICFSVASPASYENVRAKWHPEVAHHCPETPVLLVGTKLDLRDDADTVNKLAEKKLSTITTTQGLQMAKELGAVKYQECSALTQKGLKNVFDEAIRAVLNPTRRVVRTKNCEIL

SEQ ID NO: 195 - DNA, 579 bp, Ciona intestinalis
  CDS (1)..(579)
atgcaggcgatcaagtgtgttgtggttggagatggagctgttggtaaaacctgtttgctgatcagctacacaaccaatgctttccctggagaatatattcccactgtgtttgataactactctgccaatgtcatggtagatggccgccctgtcaacttgggattatgggatacagcagggcaggaggattacgacagacttcggcctctctcctacccacaaacggacgtttttctgatctgtttctcactcgtgtcaccagcctcattcgaaaacgtgcgcgcaaagtggtatccagaagtcgcacaccactgtccagatacaccggtcattctcgtgggaacaaaacttgatttacgtgacgaccaggaaaccatccaaaagctgaaagaaaagaaacttgccccaatcctctacccacaagggttgcagatggcgaaagaagtgaacgccgtaaagtacctggagtgctcggctctcacccaaaaaggcctgaaaaccgttttcgacgaggcgatccgcgccgtcctgtgccctgagcaaaagccgaagaaaaagaagccctgcgagcttttgtga

SEQ ID NO: 196 - protein, 192 aa, Ciona intestinalis
MQAIKCVVVGDGAVGKTCLLISYTTNAFPGEYIPTVFDNYSANVMVDGRPVNLGLWDTAGQEDYDRLRPLSYPQTDVFLICFSLVSPASFENVRAKWYPEVAHHCPDTPVILVGTKLDLRDDQETIQKLKEKKLAPILYPQGLQMAKEVNAVKYLECSALTQKGLKTVFDEAIRAVLCPEQKPKKKKPCELL

SEQ ID NO: 197 - DNA, 727 bp, Ciona intestinalis
  CDS (1)..(582)
atggcttcaattcgtaagaagctggtaatagttggtgatggtgcttgtggtaaaacttgcttactcatcgtgtttagcaaagatcaattcccagaagtttacgtcccaactgtttttgaaaactatgtggctgatattgaagtagactctaaacaggttgagcttgctttgtgggatacagctggtcaagaagattacgacaggcttcgtccactttcctaccccgatactgatgttattcttatgtgtttctcaatcgacagcccagattcacttgagaacattcccgaaaaatggacccctgaggtaaggcatttttgcccaagtgttccaatcattttggttggaaacaaaaaagatcttcgtaacgacagttcaacaataaaggaacttgctaaaatgaaacaatctgccgttagtaacgaagatggaatggcgatggcagagaagattggcgcttacggatatatggaatgttcagcgcgcaccaaagaaggtgttcgggaagtgtttgagcttgcaactaaagcagctttacaaaccaagaaaagaaagaaaaagagtggatgtgaagtcttgtaaagaaattttaactggagtctagcaattgacttaacattggacgcatgctttcatactccccaacaaattaatatttacaatgttggaaacgtattctgcatgacttgaactcaattactcaaatagatggcaggatttatacaca

SEQ ID NO: 198 - protein, 193 aa, Ciona intestinalis
MASIRKKLVIVGDGACGKTCLLIVFSKDQFPEVYVPTVFENYVADIEVDSKQVELALWDTAGQEDYDRLRPLSYPDTDVILMCFSIDSPDSLENIPEKWTPEVRHFCPSVPIILVGNKKDLRNDSSTIKELAKMKQSAVSNEDGMAMAEKIGAYGYMECSARTKEGVREVFELATKAALQTKKRKKKSGCEVL

SEQ ID NO: 199 - DNA, 714 bp, Trichomonas vaginalis
  CDS (11)..(613)
atttcgctagatgaagcatatcaaatgcgttgttgtcggtgatggtgcagtcggtaagacttgccttcttatctcattcactacaaatgctttcccaggtgaatatatcccaacagttttcgataactactctgcaaacgttatggctgaaggacatcctccagtcaacctccagctttgggatacagctggccaggaagactacaagaagcttcgcccactttcttaccctcaaacagatgttttcctcctctgtttctctttagtttatccagcttctctcgagaacatcgagaccatgtggatcaaagaaatcaaggaatactgcccagacaagccatacatccttgtcggtcttaagtccgatcttcgtgatgaattcgatcagcgcgcagatgaactccgcgctaagggttacgagccaatcccacgcgctaagggtgaggaaatggcaaagaagatcaacgcctgctcctacatagaatgctctgcccttaaatcatacaacctcactgaagttttcgatgaagccgtcaagtacgctctcgaaccaccagctcagcagacccagactaaagaaaagacaggtggtggctgctgcgaacttatttaaattttttgcatatatggtaccagagttaaaataaaacatgttgaatgctgtgacaaacaactttataatccgactcggtgtaataataaaagggaattagg

SEQ ID NO: 200 - protein, 200 aa, Trichomonas vaginalis
MKHIKCVVVGDGAVGKTCLLISFTTNAFPGEYIPTVFDNYSANVMAEGHPPVNLQLWDTAGQEDYKKLRPLSYPQTDVFLLCFSLVYPASLENIETMWIKEIKEYCPDKPYILVGLKSDLRDEFDQRADELRAKGYEPIPRAKGEEMAKKINACSYIECSALKSYNLTEVFDEAVKYALEPPAQQTQTKEKTGGGCCELI

SEQ ID NO: 201 - DNA, 600 bp, Colletotrichum trifolii
  CDS (1)..(600)
atggctcaaccaggagtacagtcgctgaagtgtgtggtgacgggtgacggtgctgtcggaaagacatgtttgctgatttcctacacaacgaacgcctttcctggcgagtacattcctactgtcttcgacaactactcggcgagtgtaatggtggacggaaagcctattagcttgggactgtgggatactgccggccaggaagattacgacagactgcgaccgctttcctacccccagaccgacgtcttcctgatttgcttctccatcgtcagccccccatcgtttgacaacgtcaaggccaagtggtaccccgaaatcgatcatcacgcccccaacatccccattatcctcgtcggcaccaagctggatttgagggaggatcccaacaccctcgagtccctccgccaaaagcggatggagcccgtgtcgtacgatcaagccctgatctgcgccaaggaaattaaggcacacaaatacctggagtgttctgccctgacacagaggaatctgaagagcgtttttgacgaggccattcgtgctgtcctgaaccccaggcccgtcgcgcagcagaagaagaagtcgaagtgtacgattttgtga

SEQ ID NO: 202 - protein, 199 aa, Colletotrichum trifolii
MAQPGVQSLKCVVTGDGAVGKTCLLISYTTNAFPGEYIPTVFDNYSASVMVDGKPISLGLWDTAGQEDYDRLRPLSYPQTDVFLICFSIVSPPSFDNVKAKWYPEIDHHAPNIPIILVGTKLDLREDPNTLESLRQKRMEPVSYDQALICAKEIKAHKYLECSALTQRNLKSVFDEAIRAVLNPRPVAQQKKKSKCTIL

SEQ ID NO: 203 - DNA, 618 bp, Brachydanio rerio
  CDS (1)..(618)
atggcaaacggaaccggcagcatcatgttgaaatgcgtggtcgtcggtgacggcgccgttggaaaaacttgtctgttgatgagctatgccaacgacgcctttccagaggaatatgtgcccaccgtctttgatcactatgcagtgagtgtgacggtcggggggaaacagtacctgctggggctctatgacactgcgggtcaggaggactatgatcgcctgcgacccctgtcctatcctatgacggatgtcttcctcatttgcttctccgtggtcaatccggccagcttccagaatgtaagagaggaatgggtccctgagctgcaggaatatgcaccaaacatcccttacctgctcattggcactcagattgacctgcgggatgaccccaagactatcgccaagctcaacgacgtgaaggagaagcccattgtgacggaacaaggccaaaagctagcaaaggagattggtgcctgctgctatgttgaatgctcagcactaacacagaagggcctgaagactgtgtttgatgaggccattatagccattctggctcctaagaaaggcgcactgaagcgaagactaggcccgcgctgcattaactgctgcctcatcacatga

SEQ ID NO: 204 - protein, 205 aa, Brachydanio rerio
MANGTGSIMLKCVVVGDGAVGKTCLLMSYANDAFPEEYVPTVFDHYAVSVTVGGKQYLLGLYDTAGQEDYDRLRPLSYPMTDVFLICFSVVNPASFQNVREEWVPELQEYAPNIPYLLIGTQIDLRDDPKTIAKLNDVKEKPIVTEQGQKLAKEIGACCYVECSALTQKGLKTVFDEAIIAILAPKKGALKRRLGPRCINCCLIT

SEQ ID NO: 205 - DNA, 582 bp, Xenopus laevis
  CDS (1)..(582)
atggcagcgattcggaaaaagctggtgattgttggagatggtgcctgtgggaagacctgcctgctcattgtattcagcaaggatcagttccctgaggtttatgtcccaactgtctttgagaactacattgccgatatagaagtcgatggaaaacaggtggaactggctctgtgggacacagcaggacaggaggattatgacaggctacgcccactttcttaccctgatactgatgtgattttgatgtgtttctcaattgacagccctgacagtttagagaatattcctgagaaatggactccagaagtgaagcatttctgtcccaatgtacccattattcttgtcggtaacaaaaaggatctaagaaatgatgaacacactagaagagagctgacaaagatgaagcaggagccagttaaaccagaagatggcagagaaatggccaacagaatcaatgcatttggctacctggaatgttctgctaagacaaaggatggcgtgagagaagtttttgaaatggctacacgggctgccttgcaagttaggaaacacagaaagaagcaacgttgttctattctataa

SEQ ID NO: 206 - protein, 193 aa, Xenopus laevis
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRNDEHTRRELTKMKQEPVKPEDGREMANRINAFGYLECSAKTKDGVREVFEMATRAALQVRKHRKKQRCSIL

SEQ ID NO: 207 - DNA, 1092 bp, Xenopus laevis
  CDS (25)..(606)
ggagggagctgcgagtaggaaggcatggcagccataaggaagaagctggtgattgtgggcgacggggcgtgtggcaagacttgtctcctcatcgtctttagcaaagaccagttcccagaggtctatgttcccaccgtctttgagaactacgtggccgacatcgaggtggactccaagcaggtagaactggctctgtgggacacggctgggcaagaggattacgaccgactgagacccctctcctaccctgacacagacgtcatcctcatgtgtttctccatcgacagccccgacagtttggaaaatatccctgagaaatggaccccagaagtgaaacatttctgccccaatgtgccaataatcctggtgggaaacaagaaggatctgcggaatgacgagcacacgcgccgggagttggccaaaatgaagcaggagccagtaagagcagaggagggaagggacatggccaatcgaatcagcgcctttggctacttggagtgctctgccaagaccaaggatggcgtaagagaagtgtttgagatggcgactcgggcggctctgcaggccaaacgtgggcgcaagaggagcacctgccagttactgtgaggagagaagccccatgccctcattctcccccttccctgtgccctctctctccgctgtgggctaggggagctgcggactgaggagacgcaccaataaccaatccctttcctgttctcatgggcagcgccaggccccgagtccagcaaatcacatcagtgccaggtctgtagcaacagggggtttcttacaacagtgccattgtctagtgcagggccccttcctctaaaaggcgggggggggattatttggctttagaaggccccgctgtcctgggggtcggattgtacacacgagagcgggacccctcgtgatattggttaattccaccccgaccctgtgctggcgagggttaatcctgcagctcatgagaggggtggggaggttttataataatgttgtccctgcttgaatgacattttattgtccattgtactcgagtatcaaccaataaactttgtagccatgtttagtaaaaaaaaaaaaaaa

SEQ ID NO: 208 - protein, 193 aa, Xenopus laevis
MAAIRKKLVIVGDGACGKTCLLIVFSKDQFPEVYVPTVFENYVADIEVDSKQVELALWDTAGQEDYDRLRPLSYPDTDVILMCFSIDSPDSLENIPEKWTPEVKHFCPNVPIILVGNKKDLRNDEHTRRELAKMKQEPVRAEEGRDMANRISAFGYLECSAKTKDGVREVFEMATRAALQAKRGRKRSTCQLL

SEQ ID NO: 209 - DNA, 582 bp, Brachydanio rerio
  CDS (1)..(582)
atggcagcaattcgcaagaagctggtgattgtaggagatggagcatgcgggaaaacatgtttgcttattgtgttcagtaaagaccagtttcctgaagtctacgtaccaacagtgtttgaaaactatgttgccgacattgaagttgacagcaaacaggtggaactcgctctgtgggatactgcagggcaggaggactacgacaggcttcgtcctctttcatacccagacaccgatgtcattcttatgtgtttctctattgacagtcctgacagtttagagaatattccggagaagtggacgcctgaggtcaaacacttttgtccaaacgctccaatcatccttgtgggaaacaaaaaagacctgcgcaatgatgaacacacacgcagggaactgaccaagatgaagcaggagccagttaaagcagaggaagggagagacatggccaatcgaattggagcatttggttatatggaatgttctgccaaaacaaaagacggtgttcgggaggtgtttgaaatggccactagagcggcgctgcaggcacgcaggggaaagaagagcaacaaatgctgtctgctgtga

SEQ ID NO: 210 - protein, 193 aa, Brachydanio rerio
MAAIRKKLVIVGDGACGKTCLLIVFSKDQFPEVYVPTVFENYVADIEVDSKQVELALWDTAGQEDYDRLRPLSYPDTDVILMCFSIDSPDSLENIPEKWTPEVKHFCPNAPIILVGNKKDLRNDEHTRRELTKMKQEPVKAEEGRDMANRIGAFGYMECSAKTKDGVREVFEMATRAALQARRGKKSNKCCLL

SEQ ID NO: 211 - DNA, 576 bp, Brachydanio rerio
  CDS (1)..(576)
atgcagagcatcaagtgtgtggtggtgggagacggagcggtgggaaaaacctgcctgctcatctcctacacgaccggcgccttccccaaagagtacattcccaccgtcttcgacaactacagctcccaggtcagcgtggacaaccgtaccgtcagcctcaatctgtgggacaccgcgggtcaggaggagtacgaccgccttcgcacgctgtcctatcctcaaaccaacgtcttcatcatctgcttctccatctccagccctccgtcctacgagaacatcaagcataagtggcacccggaggtgacacaccactgtcctagcgtgcccatcctgcttgtgggaaccaagagtgatctccgcaatgacgccgacgtgctgaagaagctgaaggagcagaaccaggcgcccatcacgacccagcagggtcaagcgctggctcgccaaatccacgccgtcaagtaccgtgagtgttcggcactcagtcaggacggcatcaaggacgtgtttgcagacgcagtgcgtgcctaccttagtcctcaacccgtggctaacaagaagccctgtatactcctctga

SEQ ID NO: 212 - protein, 191 aa, Brachydanio rerio
MQSIKCVVVGDGAVGKTCLLISYTTGAFPKEYIPTVFDNYSSQVSVDNRTVSLNLWDTAGQEEYDRLRTLSYPQTNVFIICFSISSPPSYENIKHKWHPEVTHHCPSVPILLVGTKSDLRNDADVLKKLKEQNQAPITTQQGQALARQIHAVKYRECSALSQDGIKDVFADAVRAYLSPQPVANKKPCILL

SEQ ID NO: 213 - DNA, 576 bp, Brachydanio rerio
  CDS (1)..(576)
atgcagaccataaagtgtgttgttgttggtgatggtgcagtgggaaagacctgtctgttgatctcctacaccaccaatgccttcccagacgagtacattcctacagtgttcgacaactacagcactcaaacctgtgtggacggccgtgctgtcagcctcaacctgtgggacaccgccggtcaggaggagtacgaccgcctgcgaaccctctcctacccgcagacacacgtcttcatcatctgtttctctgtggctagtccttcctctcacgccaacgtcaggcataaatggcacccggaggtctgccaccactgtcctggcgtacctgtgctgctggtgggcaccaagagagacctgcgaggggacaaggagaccctggagaagctgaaggagcaggggatgagtccgaccactccacagcaaggcagtgcactggcccgcagcatcggggcggtgcgatatctggagtgctcggcccttctccaggagggcgtccgagaggtcttcaacgaagcagttagggctgttctctaccccaacgccaagaagcacaccaaaaaatgtgtgctgctttaa

SEQ ID NO: 214 - protein, 191 aa, Brachydanio rerio
MQTIKCVVVGDGAVGKTCLLISYTTNAFPDEYIPTVFDNYSTQTCVDGRAVSLNLWDTAGQEEYDRLRTLSYPQTHVFIICFSVASPSSHANVRHKWHPEVCHHCPGVPVLLVGTKRDLRGDKETLEKLKEQGMSPTTPQQGSALARSIGAVRYLECSALLQEGVREVFNEAVRAVLYPNAKKHTKKCVLL

SEQ ID NO: 215 - DNA, 1124 bp, Rattus norvegicus
  CDS (100)..(684)
aggtggtggctcaggataggtgtcctctgcactaataggcctacctgggtgtagtctgacagcctgtggtctgagaagtcccaggtgctttgtacagcaatggctgccatccggaagaaactggtgattgtgggagatggagcttgtggaaaaacatgcttgctcatcgtcttcagcaaggaccagtttcctgatgtttatgtgcccacagtgtttgagaactatgtggctgatatcgaagtggatggaaaacaggtggagttggccctctgggacacagctggtcaagaagattatgatcgcttgaggccactctcctatccggacactgatgtcctcttgatatgtttctccattggcaaccctgatagctttgggaacatcccacacaaatggataccagaagtaaagcatttctgtcccaacgtgcccatcatcctggtcgggagcaagaaggatcttcggaatgacttgaacacaatacaagagttagccaagaggaaacaagagccggtgaaacctgaacaaggccgagatttggcgaacagcattggcgctttcgagtatgtggagtgttctgcaaagaccaaagatggagtgagaaaggtctttgaaaaaagccaccaaggcttgctcttgcaaacgaaccgtgtgaagaaaaagactggctgctttgtcttttgaagtctttgtgcaaacacagccctagtacagttaattttcaagtgctatttacgaatgttattgtgtaattgctagcctttttgtttatttatatatccaagattacaggtcagaagtcatcttgctactaatgtttggaaatcaactgtgattattaatgacattcattctgtctgaccttccagggtcctgactcttctgtaacagaccattctgcatttcacctgaaacccaaggcactaattgaagaacttattatctgtagaaagagagatggtaacttcatcatttagactgtaactactttctgaccaccctaccatccatatatgagctgagaagaaagctgttgagtcaccacttgagtgtttgctccctaacaactttaatcaccatccttattctcttcgaaatgtctctccaggcagctgtggtagagt

SEQ ID NO: 216 - protein, 194 aa, Rattus norvegicus
MAAIRKKLVIVGDGACGKTCLLIVFSKDQFPDVYVPTVFENYVADIEVDGKQVELALWDTAGQEDYDRLRPLSYPDTDVLLICFSIGNPDSFGNIPHKWIPEVKHFCPNVPIILVGSKKDLRNDLNTIQELAKRKQEPVKPEQGRDLANSIGAFEYVECSAKTKDGVRKVFEKSHQGLLLQTNRVKKKTGCFVF

SEQ ID NO: 217 - DNA, 576 bp, Aplysia californica
  CDS (1)..(576)
atgcaaaccataaagtgtgtggttgtgggggatggggcagtcggaaaaacctgccttctcatttcatacaccacaaataaatttccttcagaatatgtgccaacagtgtttgacaactatgcggtgaccgtgatgatcgggggagagccctacaccctgggcctgtttgataccgcgggtcaggaggactacgacaggctacgtccactcagctaccctcagacggacgtcttcctcgtctgcttctccgtggtcaccccgtcctccttcgagaatgtcagggaaaagtgggttccggagatcacacatcactgtcagcgcacgccgttcctgctggtggggacacagattgatctgcgcgacgacacgcccacggtggagaagctggccaagaacaaacagaagcccatcaccgccgaccacggggagcgtctggcccgcgagctcagggcggtcaagtacgtcgagtgctccgccctcaaccagagaggtctgaagaacgtgtttgatgaggctatcctggcagcgctagaacccccagagccacccaagaaaaagaaatgtgtgctcttgtaa

SEQ ID NO: 218 - protein, 191 aa, Aplysia californica
MQTIKCVVVGDGAVGKTCLLISYTTNKFPSEYVPTVFDNYAVTVMIGGEPYTLGLFDTAGQEDYDRLRPLSYPQTDVFLVCFSVVTPSSFENVREKWVPEITHHCQRTPFLLVGTQIDLRDDTPTVEKLAKNKQKPITADHGERLARELRAVKYVECSALNQRGLKNVFDEAILAALEPPEPPKKKKCVLL

SEQ ID NO: 219 - DNA, 579 bp, Aplysia californica
  CDS (1)..(579)
atgcaggctatcaagtgtgtggtagtcggggacggtgctgtgggtaagacatgtcttcttatcagctacactaccaatgccttccccggagaatacattccaactgtctttgacaactactctgcaaatgttatggtagatggcaagccaatcaatcttggactatgggatactgctggacaagaggactatgatcgtctcagacccttgtcatatccgcaaactgatgtctttcttatatgtttttccttgatcagtcctacaagtttcgagaatgttcgagcaaagtggtttcctgaagtgagccatcattgccctcatacccctatcatcttagtgggtaccaagcttgatctgcgtgaagacaaggagacaattgagaaactgagagacaagaagctgtcccctatcacctaccctcaagggctggccatggcaagggagataagtgctgtgaagtatcttgagtgctcagccttaacccaaaaagggctgaagaatgtctttgatgaggctattcgggctgttttgtgccctaagcctaagccaaagaagaagaaaggatgcgaaattttgtga

SEQ ID NO: 220 - protein, 192 aa, Aplysia californica
MQAIKCVVVGDGAVGKTCLLISYTTNAFPGEYIPTVFDNYSANVMVDGKPINLGLWDTAGQEDYDRLRPLSYPQTDVFLICFSLISPTSFENVRAKWFPEVSHHCPHTPIILVGTKLDLREDKETIEKLRDKKLSPITYPQGLAMAREISAVKYLECSALTQKGLKNVFDEAIRAVLCPKPKPKKKKGCEIL

SEQ ID NO: 221 - DNA, 558 bp, Schistosoma japonicum
  CDS (1)..(558)
atgcaagccatcaaatgtgtagttatcggtgatggtgctgtaggaaaaacatgtttgctcattagctacactacaaatgcttttcctggtgagtatgtcccaactgtcttcgataactactctgccaatgtaatggttggtgaaaaacgtgtgaaccttggtttgtgggatacagctggtcaagaagattatgatagattacggccactatcgtatccacagactgacgttttcttggtttgcttttctttgatcagtccttcatcatttgataacgttcgtgctaaatggtatccagaaatacgccacttttctccaaacacacccattattcttgttggaacaaaactggatctccgcaacagttctaccagtcctaaaaacaaccaaccatcaatatcttatgaacaaggtttaattatggcaagagagattggagctcataagtatctagaatgttcagcgttaactcaggatggattaacaggatgttttcgatgcagctatccgggcagtactcatgcctccagctcggaaaaaaaaacataccttatgtga

SEQ ID NO: 222 - protein, 185 aa, Schistosoma japonicum
MQAIKCVVIGDGAVGKTCLLISYTTNAFPGEYVPTVFDNYSANVMVGEKRVNLGLWDTAGQEDYDRLRPLSYPQTDVFLVCFSLISPSSFDNVRAKWYPEIRHFSPNTPIILVGTKLDLRNSSTSPKNNQPSISYEQGLIMAREIGAHKYLECSALTQDGLTGCFRCSYPGSTHASSSEKKTYLM

SEQ ID NO: 223 - DNA, 576 bp, Blumeria graminis
  CDS (1)..(576)
atgtctcttagatgcgttgttgttggcgatggtgccgttggaaaaacttgtcttctcatcagctatacaacaaataaattcccctccgaatatgtccctactgtcttcgataattatgctgttactgttatgattggcgatgagccatatacccttggcctattcgacactgctggtcaagaagattacgatcgcttacggcccctttcataccctcaaactgatgtatttctcgtctgtttctctgttacttcacccgcatcatttgaaaatgttcgcgagaaatggtttcctgaagtccatcatcactgccctggagtcccttgcttaattgttggcacccaaacagatctgagagatgatcttagcgttcgagaaaagttaaacaaacagaaaatgcaaccagttaagagagaagatggagagagaatggctaaggatttgggtgcagttagatatgtggaatgcagcgcgttgacacagtataagttgaaggatgtattcgatgaggctatagtggctgcactagaacctcccgctccaaaaaagaagcatcgaaactgtctaatcctatga

SEQ ID NO: 224 - protein, 191 aa, Blumeria graminis
MSLRCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQTDLRDDLSVREKLNKQKMQPVKREDGERMAKDLGAVRYVECSALTQYKLKDVFDEAIVAALEPPAPKKKHRNCLIL

SEQ ID NO: 225 - DNA, 757 bp, Brassica napus; identical to SEQ ID NO: 73
  CDS (164)..(757)

SEQ ID NO: 226 - protein, 197 aa, Brassica napus; identical to SEQ ID NO: 74

SEQ ID NO: 227 - DNA, 1015 bp, Zinnia elegans
  CDS (170)..(763)
ggtttgttcttggggtttggctggaaaaagattcaatttttcggtgtgtttttgggaaaaagatttggtgaaatttgtgggtgttgaagaaagattgttggggattattgggtgtgagtgatttggtggtgatcaggtcttctgggtgtggaagaagatctgaagaaatatgagtgcatcaagatttataaagtgtgttactgttggtgatggggctgttggaaagacttgtttgttgatttcttacaccagtaataccttccctacggattacgtcccaacggtatttgataatttcagtgctaatgtagttgtcaatggaagcacagttaatctaggcttgtgggacactgctggacaggaggactataacagattaagaccgttgagttatcgtggagctgatgttttcattttggcgttctcactcattagcaaggctagctatgagaacgtttccaagaagtggattccagaattgaagcattatgctcctggtgttccaatcgttcttgttgggacgaaactagatctccgagatgataagcagttttttgtagatcaccctggtgcaactcctattaccactgcacagggagaggaattaaagaagacaatcggtgctcctgagtacattgaatgtagttcaaaaacacaattgaatgtgaagcaagttttcgatgctgccattaaagtcgttctggcgcctccaaaggcgaagaaaaagaagggaaaagctcaaaaggcatgctcaatattgtgatgaagaagatgaaaaccagttgttcaacgcttatctcgtcttgaattcaattccatatgttggttgatttgtattttgatctttgagtactcgaaaatcttggtgtactaattctgtatcttggtcaaaaatttgtatttccatgctcgttttctgtttgcgactgttttactactttgttcttctaagttgaaaaatcggtatctatcgttgaatcaatgaattccattctaatgaaaaaaaaaaaaaaaa

SEQ ID NO: 228 - protein, 197 aa, Zinnia elegans
MSASRFIKCVTVGDGAVGKTCLLISYTSNTFPTDYVPTVFDNFSANVVVNGSTVNLGLWDTAGQEDYNRLRPLSYRGADVFILAFSLISKASYENVSKKWIPELKHYAPGVPIVLVGTKLDLRDDKQFFVDHPGATPITTAQGEELKKTIGAPEYIECSSKTQLNVKQVFDAAIKVVLAPPKAKKKKGKAQKACSIL

SEQ ID NO: 229 - DNA, 843 bp, Zinnia elegans
  CDS (114)..(710)
aaacacttgtcccattactactacacttattccttttatcttcctttcccttgcttaacaacaacaaccaaaccacttgtcgatctctttgtatcatattccgatcgaccgaaatggcagcagcagccaccagattcatcaagtgcgtcaccgttggcgacggtgcggtcggaaaaacctgcatgctcatctcctacaccagcaatactttccccaccgattatgtgccgacagtgtttgataacttcagtgcgaatgttgtggtcggagacagcactgtcaatcttggcctttgggatactgccggtcaggaggattataacagactgaggccactgagttatagaggtgcagatgtgtttttattggcattttctctcattagcagacccagttatgaaaacatctccaagaagtggatctcagaactaaggcattatgccccagatgtccccattgtgctggtgggaaccaaattagatttacgtgaagacaaacaatatttgagtgatcatccaaatgttacagccatcacaacttctcagggtgaagaactgaagaaaagtattggtgcagcagtgtacattgagtgtagctccaaaactcaacagaatgtgaaggctgtttttgatgctgcgattagagttgttttacaaccaccaaagctgaagaaaaagcgaagcaagcaacgactatgtgtctatctatagatctgcttctctgtgcaattgcatgtataatgttctatgtataatgtctttctcatttagaactttaaatgatgtaatgaaatccaagtcatcaaatggtttccttgtaaaaaaaaaaaaaaaaaaaaaaaaa

SEQ ID NO: 230 - protein, 198 aa, Zinnia elegans
MAAAATRFIKCVTVGDGAVGKTCMLISYTSNTFPTDYVPTVFDNFSANVVVGDSTVNLGLWDTAGQEDYNRLRPLSYRGADVFLLAFSLISRPSYENISKKWISELRHYAPDVPIVLVGTKLDLREDKQYLSDHPNVTAITTSQGEELKKSIGAAVYIECSSKTQQNVKAVFDAAIRVVLQPPKLKKKRSKQRLCVYL

SEQ ID NO: 231 - DNA, 659 bp, Ciona intestinalis
  CDS (24)..(605)
  MISC_FEATURE (27)..(27): n is a, t, g, or c
  MISC_FEATURE (94)..(94): n is a, t, g, or c
ataaaatttattgaaacacgaagatgncttcaattcgtaagaagctgaaaatagatggcgaaggggcttgtggtaaaacttgcttactcatcgngtttagcaaagatcaattcccagaagtttacgtcccaactgtttttgaaaactatgtggctgatattgaagtagactctaaacaggttgagcttgctttgtgggatacagctggtcaagaagattacgacaggcttcgtccactttcctaccccgatactgatgttattcttatgtgtttctcaatcgacagtccagattcacttgagaacattcccgaaaaatggacccctgaggtaaggcatttttgcccaagtgttccaatyattttggttggaaacaaaaaagatcttcgtaacggcagttcaacaataaaagaacttgctaaaatgaaacaatctgccgttagtaacgaagatggaatggcgatggcagacaagattggcgcttacggatatatggaatgttcagcgcgcaccaaagaaggtgttcgggaagtgtttgagcttgcaactaaagcagctttacaaaccaagaaaagaaagaaaaagagtggatctgaagtcttgtaaagaaattttaactggagtctagcaattgacttaacattggacgcatgctttcat

SEQ ID NO: 232 - protein, 193 aa, Ciona intestinalis
  MISC_FEATURE (2)..(2): Xaa is Ser, Pro, Thr or Ala
  MISC_FEATURE (24)..(24): Xaa is Glu, Val, Ala or Gly
MXSIRKKLKIDGEGACGKTCLLIXFSKDQFPEVYVPTVFENYVADIEVDSKQVELALWDTAGQEDYDRLRPLSYPDTDVILMCFSIDSPDSLENIPEKWTPEVRHFCPSVPIILVGNKKDLRNGSSTIKELAKMKQSAVSNEDGMAMADKIGAYGYMECSARTKEGVREVFELATKAALQTKKRKKKSGSEVL

SEQ ID NO: 233 - DNA, 567 bp, Schistosoma mansoni
  CDS (1)..(567)
atgcaagccatcaaatgtgtggttgtcggtgatggcgctgtcggaaagacctgtttactcattagctacacgacgaatgcctttcctggtgagtacgtcccaaccgttttcgataactattctgccaacgtaatggttgaccgaaaacctgtgaaccttggtttgtgggatacagctggtcaggaggattatgacagactaagaccactctcatatccacaaactgatgtgtttttggtgtgcttctccttagtcagtcgcacatcgttcgagaatgttcgtagtaaatggcatccggagatatccgcatatgttccaagagctcctattattcttgtcggaactaaacgagaccttcgggatagtcctaatggcctaaaatcaacaacgtttccagtcacgtatgcagagggttgcaggatggccagagaaattaaagctgtgaaatacctggaatgctctgctctaactcagtttggattaaaagatgtcttcgacgaagctattcgagcagtactgatgcctgaagggaagaaaaagaaacatagttcatgtgaattaatttaa

SEQ ID NO: 234 - protein, 188 aa, Schistosoma mansoni
MQAIKCVVVGDGAVGKTCLLISYTTNAFPGEYVPTVFDNYSANVMVDRKPVNLGLWDTAGQEDYDRLRPLSYPQTDVFLVCFSLVSRTSFENVRSKWHPEISAYVPRAPIILVGTKRDLRDSPNGLKSTTFPVTYAEGCRMAREIKAVKYLECSALTQFGLKDVFDEAIRAVLMPEGKKKKHSSCELI

SEQ ID NO: 235 - DNA, 600 bp, Penicillium marneffei
  CDS (1)..(600)
atggcgtctgggcctgcgactcaatcgttgaagtgtgtggtgaccggtgatggtgctgtcggcaagacatgtctcctgatatcatacaccaccaatgcctttcccggcgaatacattcccaccgtattcgacaactactccgctagtgtcatggtcgacggcaggcccatcagcctcggactctgggatacagctggtcaagaggattatgaccgtctccgccccttatcctaccctcaaaccgacgtcttcttgatctgcttctctatcgtctctccaccatcctttgacaacgtaaaagccaagtggtttcccgaaatcgagcaccatgcacccggcgtgcccatcattcttgtcggcacaaagcttgatttgagagaagatagagctaccgctgaggcgctgcgagccaaaaagatggagccggtgtcgtatgagcaggcgcttgcagttgcaaaggagattagggcgcataagtatctggagtgttcggccttgacccagaggaatttgaagagcgtgtttgatgaagctattcgggccgtcctcaatcctcgccctcaacccaagaacaaggcaaaacgatgcactattctgtaa

SEQ ID NO: 236 - protein, 199 aa, Penicillium marneffei
MASGPATQSLKCVVTGDGAVGKTCLLISYTTNAFPGEYIPTVFDNYSASVMVDGRPISLGLWDTAGQEDYDRLRPLSYPQTDVFLICFSIVSPPSFDNVKAKWFPEIEHHAPGVPIILVGTKLDLREDRATAEALRAKKMEPVSYEQALAVAKEIRAHKYLECSALTQRNLKSVFDEAIRAVLNPRPQPKNKAKRCTIL

SEQ ID NO: 237 - DNA, 845 bp, Schistosoma japonicum
  CDS (39)..(617)
ccgggcccccccttggactttactggtttgctggagtgatgagtgcaataaggaaaaagctcgttattgttggggatggagcctgtgggaaaacttgtctactaatagtatttagcaaagaccagtttcctgaagtttacgttccgactgtattcgaaaactatgtcgcggatattgaggtagataacaaacaggttgaattggcactttgggatactgctggtcaagaagactatgacagattaagaccactttcttaccccgatacggatgttattttaatgtgctttagcatcgacactccagatagtttggaaaacatacctgagaaatggacaccagaagtccgacatttctgccctgatgtacctattgtcttagttggaaacaaaaaggacttgcgaagtgaaaactcaacaagagatgacggacatagaggaaaacaggaatttgttaaatcggatgagggttatgcaatggccgatcgtattcatgcttactcatatatcgagtgttcagctaagacgaaggaaggagttcgtgaagttttcgagaccgcgactagagctgctttacagtcgaagaaaacgaaaaagaagaagtgtgatctaatttgattctcggttttctccaaatatggttatccggttttaaagacttcttacattccccccttccgatttcgcttcaggatattaaatttcgactttttattaactgcttgtttcttcaacaaacatattttggttttttaaaaagacaatccattccatgataacctttattatccgtttttatcttgatactaaaatctgtcaggcctgttaaaaaaaaaaaaaaaaaaa

SEQ ID NO: 238 - protein, 192 aa, Schistosoma japonicum
MSAIRKKLVIVGDGACGKTCLLIVFSKDQFPEVYVPTVFENYVADIEVDNKQVELALWDTAGQEDYDRLRPLSYPDTDVILMCFSIDTPDSLENIPEKWTPEVRHFCPDVPIVLVGNKKDLRSENSTRDDGHRGKQEFVKSDEGYAMADRIHAYSYIECSAKTKEGVREVFETATRAALQSKKTKKKKCDLI

SEQ ID NO: 239 - DNA, 582 bp, Ustilago maydis
  CDS (1)..(582)
atgcagaccatcaagtgtgtagtcgtcggagacggtgccgtcggaaagacgtgtcttcttatctcgtatacaaccaacgccttcccgggcgaatacatccccacagtgtttgacaactattcggcaaacgtcatggtcgacggtaaacccgtctctctcggtctctgggatactgcgggtcaagaagactacgaccggttaagaccgctctcgtacccgcaaaccgacgtgttcctcgtgtgcttttcactggtgagtccaccttcgttcgaaaacgttcgaaccaagtggtggcccgaagtgtcgcatcacgctcccaacattcccaccatcctcgtgggaaccaagttggatctgcgcgaggatccagaaacgattgccaagctgcgcgatcgcaggatgcagcctatcacgtatgcgcagggcaatcagatggcgagggacattcacgctaccaagtatttggagtgctctgcactcacccagaagggattgaagggcgtatttgatgaagcgatcaggagcgttttggctcctgcaccagtccagagtaagaagaaaaacaactgtttgattctttaa

SEQ ID NO: 240 - protein, 193 aa, Ustilago maydis
MQTIKCVVVGDGAVGKTCLLISYTTNAFPGEYIPTVFDNYSANVMVDGKPVSLGLWDTAGQEDYDRLRPLSYPQTDVFLVCFSLVSPPSFENVRTKWWPEVSHHAPNIPTILVGTKLDLREDPETIAKLRDRRMQPITYAQGNQMARDIHATKYLECSALTQKGLKGVFDEAIRSVLAPAPVQSKKKNNCLIL

SEQ ID NO: 241 - DNA, 1196 bp, Ustilago maydis
  CDS (436)..(1080)
aattgcgatgggatgcaaccgtccacagggtcccctaagcccgtgggttcatgtggtcaacctcgccacggccttgatcaacacccaccaccgcattcgtagattttcaaacaataccggccccatttcatcgccttttggttttggaagtcaggaacaagcagcatcatagcaagtggacgcaccaacgagcccaagttacagccaatggacattcagctttcctccggttcgctcgacggccgaatcctcctcctctctgtcgggaacgggcgcacaaccattgtaggaattgacaccgattgtttcaattgtcccagccagaagtttgcaccgctcagcacctttggcattggtaggaacagaaatcccttttcgtttccatcgcaaacaggaacactgtcttgttgatcatctttgctcccgccgctcagcatggcaccggcagcaatttgtaggaagcttgtaattgtcggcgacggtgcttgcggcaagacgagtttgctttgcgtttttgccattggcgagttcccgcaagagtatgaacccaccattttcgaaaactacgtcgccgagatccgccttgatggcaagcctgtccagctggcgctatgggacaccgcgggtcaggaagaatacgagcgtcttcgtccactctcctactcacaagcacacgtcatcttgatcgcctttgccatcgatacacccgactcgctcgaaaacgtgcaagtcaagtggatggaggaggtacgtcaaatatgcggcccctcagtgcctgtgctcctggtaggctgcaagaaggatcttcgcgaaaatgccatcgctaagggcaagccggttcagggtcactatgtaaagagacaacaggctaaactggtagcagcacagatcggcgctcgatcgtatcacgaatgctcatcactcaacaaccaaggcgtcgacgccgtgttcgaagccgcgacgcgcgcggccatgcttgtgcgcaattccggtgcttcttcaggaggcgccatctcgcagagcaagaccaaggaggcattacacaacgatgctggctcttgcaaatgtatcgtcctctagaaatctctcttgtgcttcgtcttgtcgacccttgtcctaagcctcgctctcgtctgcctttccatcgtacagtcgctctccctgcatttttgtccctccactcctcccatgttcta

SEQ ID NO: 242 - protein, 214 aa, Ustilago maydis
MAPAAICRKLVIVGDGACGKTSLLCVFAIGEFPQEYEPTIFENYVAEIRLDGKPVQLALWDTAGQEEYERLRPLSYSQAHVILIAFAIDTPDSLENVQVKWMEEVRQICGPSVPVLLVGCKKDLRENAIAKGKPVQGHYVKRQQAKLVAAQIGARSYHECSSLNNQGVDAVFEAATRAAMLVRNSGASSGGAISQSKTKEALHNDAGSCKCIVL

SEQ ID NO: 243 - DNA, 576 bp, Ustilago maydis
  CDS (1)..(576)
atgcagaccatcaagtgtgttgttgtcggagatggtgcggtcggtaagacctgcctgttgatttcgtacaccaccaacaagtttccctcggagtatgttccgacagtgtttgacaactacgccgtgactgtcatgattggcgaggatccgtacacactcggattgttcgataccgccggtcaggaggactacgaccgactgcgaccgctttcatacccgcagacggatgtcttcctggtctgcttctcggtcacctcaccagcctcgttcgaaaatgtcaaggaaaagtggttcccggaggtgcatcaccattgccctggtgtgccgtgcctgattgtgggaacccaggtggatttgcgcgacgaccacgccgtcatcgagaagcttgcacgttcaaagcagcgtcctgtgccctttgaggcgggtgagcgtttggcgagagagttgggtgcggtcaagtacgtcgagtgctcggcgctgacgcaaaagggattgaagaacgtcttcgacgaggccatcgtggctgcgctggaaccgcctgtaatccgcaagaagtccaagtgcgccattctctga

SEQ ID NO: 244 - protein, 191 aa, Ustilago maydis
MQTIKCVVVGDGAVGKTCLLISYTTNKFPSEYVPTVFDNYAVTVMIGEDPYTLGLFDTAGQEDYDRLRPLSYPQTDVFLVCFSVTSPASFENVKEKWFPEVHHHCPGVPCLIVGTQVDLRDDHAVIEKLARSKQRPVPFEAGERLARELGAVKYVECSALTQKGLKNVFDEAIVAALEPPVIRKKSKCAIL

SEQ ID NO: 245 - DNA, 633 bp, Encephalitozoon cuniculi
  CDS (1)..(633)
atgaaggagacaaactggataatgaacagtgaaacacaccgatctggaaaagttgtcattgtgggagatggagcctgcggtaaaacatgtctgctcgaggtgtttagaagaaaccagtttcctgaaacatacatcccaaccgttgtcgacaacttcgtgaaggaagtgaaggtcgctgacgacaaatatgtttccttagccttatgggatactgcagggcaagaggattatgatacaatcaggcctctttcatacaaggagacagatcttgtactactgtgctatacaatagaaaacaagaagaaaatcccaaacatctcaagaaaatggctgatggagataaagaactactgcccctcgtcgcaattctttcttatcgggttgaagaaggatataagggatatggatgatccgacaatcgacaagtcgtcaatagtcacggaaagcgagggtcggaagatcgcagataatatcaatgctgcgaggttttttgagtgctctgcccgtaccagagaaaacgtgaaccttgtattcgtggaagccgcaaagtatatatgggacacgaagcaggctgcttctgatgccagatcgtgtggctttttttcgtgcataagatgctgccgttatagatag

SEQ ID NO: 246 - protein, 210 aa, Encephalitozoon cuniculi
MKETNWIMNSETHRSGKVVIVGDGACGKTCLLEVFRRNQFPETYIPTVVDNFVKEVKVADDKYVSLALWDTAGQEDYDTIRPLSYKETDLVLLCYTIENKKKIPNISRKWLMEIKNYCPSSQFFLIGLKKDIRDMDDPTIDKSSIVTESEGRKIADNINAARFFECSARTRENVNLVFVEAAKYIWDTKQAASDARSCGFFSCIRCCRYR

SEQ ID NO: 247 - DNA, 588 bp, Mucor rouxii
  CDS (1)..(588)
atggctgaaatcagacgaaaacttgtgattgttggagatggtgcttgtggtaaaacctgtttgttgattgtcttttcaaagggtacttttcctgagttctatgttcccaccgtttttgaaaattacgtagctgatgtcgaagtcgatggaaaacacgtggaattagctttatgggatacagcaggccaagaagattatgatcgtctccgtcccttgtcttaccctgattctcatgttatcttgatttgttttgctgttgattcacccgattcattggaaaacgttcaagagaagtggatctctgaagtactccacttctgtcaaggtttacctattgttttagttggttgtaagaaagatttaagaaatgatcctggaacaattgaagaacttagaagaaactctcaaaaacctgtcagttcagaagagggtgcttctattgctcaaagaattagtgcttacaagtaccttgaatgttctgccaagactggtgaaggtgtacgtgaagtatttgaacacgcaacaagagctgcattaatggtttctaagaagaaaaagtcaaagagtggtgtctgcaaccttttgtaa

SEQ ID NO: 248 - protein, 195 aa, Mucor rouxii
MAEIRRKLVIVGDGACGKTCLLIVFSKGTFPEFYVPTVFENYVADVEVDGKHVELALWDTAGQEDYDRLRPLSYPDSHVILICFAVDSPDSLENVQEKWISEVLHFCQGLPIVLVGCKKDLRNDPGTIEELRRNSQKPVSSEEGASIAQRISAYKYLECSAKTGEGVREVFEHATRAALMVSKKKKSKSGVCNLL

SEQ ID NO: 249 - DNA, 1014 bp, Neurospora crassa
  CDS (259)..(1014)
atgtcgtcgtcaagcaagttccgcagctcacaccactatcattcgcagtcggtgtcgtcaatcctaggcaggcacgatagcaccagccccggcgcagaactccaacgacgaccgaccaccacctcgtcctacacatcctctggtagcgccagccgacgagtaccacgcgacaacgggacgagatcgagcgatgggacagtgagtaccatgatgagcaccacatcgtcgaccggaagagaatcagcagcaactacggccatgaccgagggcccggcctactccaagaaggtggtggtcgtgggcgatggcggttgcggaaagacatgtctcctgatcagttatagtcagggatacttcccagagaaatatgtcccaaccgtctttgagaactacatcacctacccaacgcatccaccgaccggtaagaccgtcgagctcgccctgtgggataccgccggccaagaggaatacgaccgcttgcgaccgctttcatacccagaaaccgaccttatttttgtctgcttcgccattgactgccccaactccctcgagaatgtcatggacaagtggtaccccgaagtcctccacttctgtccgtatacaccccttatcctcgtcggcctcaagtccgacctccgcaataagaagacgtgcatcgacatgctcaagacacaaggtctcacccccgtcaccaccgaacaaggactcgccgtcgctaagaagatgggcgctcagtacatggagtgctcatcaaaggagatgaagggtgtagaggagatttttgagcaggccatcctcacagtagtcgccaacgacaggaaaacactggaacaggaagccgcgaacggcatgctgggtgttggcgcgggctcgggaagcggaaagggcagcggaatctcgttcagcagtggtgacaaggccggttccgggatagggcccgtcaaggcggccggtgtgggtggcacgattgtcccgaaaacgaggaagaagaagagaaagtgtggtatgatgtga

SEQ ID NO: 250 - protein, 251 aa, Neurospora crassa
MTEGPAYSKKVVVVGDGGCGKTCLLISYSQGYFPEKYVPTVFENYITYPTHPPTGKTVELALWDTAGQEEYDRLRPLSYPETDLIFVCFAIDCPNSLENVMDKWYPEVLHFCPYTPLILVGLKSDLRNKKTCIDMLKTQGLTPVTTEQGLAVAKKMGAQYMECSSKEMKGVEEIFEQAILTVVANDRKTLEQEAANGMLGVGAGSGSGKGSGISFSSGDKAGSGIGPVKAAGVGGTIVPKTRKKKRKCGMM

SEQ ID NO: 251 - DNA, 915 bp, Oryza sativa
  CDS (85)..(678)
gggaccatcactaccaccacttcaccaccaaacccaaccaagaacaagttttcaggggcaaattaagaagagcttggtgacgatatgagcacggcgaggttcatcaagtgcgtcaccgtcggcgacggcgccgtcggcaagacatgcatgctcatctcctacaccagcaacactttccccacggattatgtgccgacggttttcgacaacttcagcgccaacgtggtcgtcgacggcaacacggtgaaccttgggctctgggatactgctggacaagaggattacaataggctgaggcctctcagctacagaggagctgatgtctttttactagcattttccctcatcagcaaagcgagctatgagaatattcacaagaagtggataccagagctgaggcattatgctcctaatgtgccaatcgtattagttggaaccaagcttgacttgcgtgaggacaagcagttcttcctggaccaccctggtctagcacctatttccactgcacagggggaggagctgaagaggatgataggtgctgcggcgtacatcgaatgcagctccaagacgcagcagaatgtgaaatcagtattcgactcggcgatcaaagttgtactttgcccgccaaagccgaagaagaagaacaccaggaagcagaggagttgctggatcctatgagtgataaacagcaagattggcgtattccgcaggaaacctgtattatttttacagtgtgtgttgtgttatgtttgtgtgttgcagattagatgcagtttgggttacaaaatttgctgggtctgaaatattcagctcagtgcttcttgagtactacctctgatgattcttacaaaagtgttctttggttggttcagatatatatattatgattattataaaaaaaaaaaaaaaaaaaaa

SEQ ID NO: 252 - protein, 197 aa, Oryza sativa
MSTARFIKCVTVGDGAVGKTCMLISYTSNTFPTDYVPTVFDNFSANVVVDGNTVNLGLWDTAGQEDYNRLRPLSYRGADVFLLAFSLISKASYENIHKKWIPELRHYAPNVPIVLVGTKLDLREDKQFFLDHPGLAPISTAQGEELKRMIGAAAYIECSSKTQQNVKSVFDSAIKVVLCPPKPKKKNTRKQRSCWIL

SEQ ID NO: 253 - DNA, 1010 bp, Zea mays
  CDS (74)..(718)
cactccgtccctctcctccaggaccgcccgctcttatcccgtttctcccttctctgggctcggagaatcggagatggcgtccagcgcctctcggttcatcaagtgcgtcacggtcggcgacggtgccgtgggcaagacatgtatgctcatctgctacaccagcaacaagttccccactgattacatacccacggtgttcgacaatttcagtgcaaatgtcgttgtggatggcaccacggtgaatttgggcctgtgggataccgcagggcaggaagattacaaccgactgaggcctctaagctaccgtggtgcagatgttttcgtgcttgcattctcacttgtgagtcgagctagctatgagaatatcatgaagaagtggataccggagcttcagcattatgcacgtggggtgcctgttgtgttggtaggcacaaaatttgatcttcgtgaagacaagcactacttgatggaccatcctgggttggtgcctgttaccacagcacaaggggaggaacttcgtagacaaattggtgctatgtattacatcgaatgcagttcgaagacacagcagaatgtcaaagctgtgttcgatgctgccatcaaggttgtaatccagcctccaactaaactaagagaaaagaagaaaaagaaatcacgcaagggatgttcgatggtgaacatcttatctggaagaaaaatgctatgcttcaagtcctgaatgatcgaagggggtcttacctgaactaataccatgagtgtgaccccaagttcgcgaagcttgaaatcttgatgcgctcgttgcgcatgtatatttgcacctttggttattaatcactagaggtagatgattgaaactaatctgcttaaccaatgtgcactgctgggcgctggcgtggttagctatatcagttaggcagttcgacagaggtcaaagagattgagattttgttctttcttggcaatgtcacagcttttgtgaaaaaaaaaaaaaaaaaaaaaaaaaaaaaaaa

SEQ ID NO: 254 - protein, 214 aa, Zea mays
MASSASRFIKCVTVGDGAVGKTCMLICYTSNKFPTDYIPTVFDNFSANVVVDGTTVNLGLWDTAGQEDYNRLRPLSYRGADVFVLAFSLVSRASYENIMKKWIPELQHYARGVPVVLVGTKFDLREDKHYLMDHPGLVPVTTAQGEELRRQIGAMYYIECSSKTQQNVKAVFDAAIKVVIQPPTKLREKKKKKSRKGCSMVNILSGRKMLCFKS

SEQ ID NO: 255 - DNA, 579 bp, Schizophyllum commune
  CDS (1)..(579)
atgcagaccatcaagtgtgtagttgttggagacggtgcggttggaaagacgtgcctgttgatctcctatacgaccaacaagttcccgagcgagtatgtgcccaccgtcttcgacaattatgccgtgaccgtcatgatcggcgaggacccctatacactgggtctgtttgatactgctggccaggaggattacgatcgactccggccgttgtcgtacccgcagacggacgtgtttcttgtgtgctttagtgtaacatctccagcctccttcgagaacgtaaaggagaaatggttcccggaggttcgccaccactgtccgggcgtgccctgcctcatcgtcggcacgcaaatcgacttgagggacgactcgcaggtgatcgagaagctggcgcggcaaaagcagagaccggtcacgagcgaccaaggcgagcggctcgttcgggaacttggcgcggtcaagtacgtcgagtgctcagcactcacgcagaagggattgaagaacgtgtttgatgaggccatcgtcgccgcgctggagccacccgtggtgaagaagaaggggccgaaatgtgtcatcctttga

SEQ ID NO: 256 - protein, 192 aa, Schizophyllum commune
MQTIKCVVVGDGAVGKTCLLISYTTNKFPSEYVPTVFDNYAVTVMIGEDPYTLGLFDTAGQEDYDRLRPLSYPQTDVFLVCFSVTSPASFENVKEKWFPEVRHHCPGVPCLIVGTQIDLRDDSQVIEKLARQKQRPVTSDQGERLVRELGAVKYVECSALTQKGLKNVFDEAIVAALEPPVVKKKGPKCVIL

SEQ ID NO: 257 - DNA, 1075 bp, Aspergillus fumigatus
  CDS (197)..(793)
ttaacctccaaaagatatacccttaaagattattatcgccccatccgccttcacttgacgctaaacccccccaagaattcacttcgacgctaattgatcgctatcatttgggttcatctttacaagctgttcatcatcaaatcctctctgtgattttcttctctgtgcatatattcttaattccaacaacaaaaacatggcgtccggccccgctactcagtcattaaagtgtgtggtgacaggtgatggtgcagttggaaagacatgcctcctcatctcgtataccaccaatgcattccccggagaatacatccctaccgtatttgacaactatacggctagtgtgatggtagatggtaggcccatcagcttgggactgtgggatactgctgggcaagaagattatgaccgactgagaccgctgtcctaccctcaaaccgacgtcttcctcatctgcttctccattgtcagccctccttcgtttgacaacgtcaaggcaaagtggtacccggagattgagcaccatgcccccaatgttcccatcatccttgttggtaccaaactcgatctgagagacgatcccgcgacagcagaatccctccggcagaaaaagatggacctgtctcgtacgagacactggccgtcgccaaaagagatccgagcgcacaagtatctcgaatgttctgccctcaggcagcgcaacttcaaaagcgtctttgatgaagccattcgtgctgtcctcaaccctggacctgccgcaaaaccgaagagcaagaaatgcaccatactgtagaccattactttcagcttttcatcatctaatcataaacaactaattcggcgtctgggatagttgaaggttttgcaatgatccccttgatgattgttccaactgtgttcatatttctttctctctttctcggtcacatgtcatgatcctgatgagcttctttctgggtcaggacacccctttcctcatcttgtcgtctttttgtgcacatgcagcataaacttgtaacatgctacgccataacaggaagctgtcacttaatcgatttaacctccattgtcctaa

SEQ ID NO: 258 - protein, 198 aa, Aspergillus fumigatus
MASGPATQSLKCVVTGDGAVGKTCLLISYTTNAFPGEYIPTVFDNYTASVMVDGRPISLGLWDTAGQEDYDRLRPLSYPQTDVFLICFSIVSPPSFDNVKAKWYPEIEHHAPNVPIILVGTKLDLRDDPATAESLRQKKMDLSRTRHWPSPKEIRAHKYLECSALRQRNFKSVFDEAIRAVLNPGPAAKPKSKKCTIL

SEQ ID NO: 259 - DNA, 594 bp, Aspergillus fumigatus
  CDS (1)..(594)
atggagctgtgcgggcgccagaaagttgtccagcgcaagatggtactcttaggagatggtgcttgcggcaagacgtcagctttgaatgtgtttacaagagggttcttcccgacagtctatgagccgactgtttttgaaaactatgtccatgacattttcgtcgataacgtacacatggagttgtcgctgtgggatacagccggtcaagaagaattcgatcgattacgagcactgtcctacgaggatacacatgttattatgctatgtttcagcgtcgatagccctgactcgttcgaaaatgtggcgacgaaatggattgatgagattcgcgagaattgccccggcgtgaagttagtcctcacggcactcaaatgcgatctgcgaaaagacgacgagttgaacgacaacccgaacgccatcacgttcgaacaaggattagcgaaagcaaaggaaatcggcgctgtaaaataccttgaatgctctgctgttcagaatcgcggtatcagggagaccttttatgaagccgccaaggtcgctcttgatgtgaagcctgcaggatccagcgggtccaagggacagtgcattatcctctga

SEQ ID NO: 260 - protein, 197 aa, Aspergillus fumigatus
MELCGRQKVVQRKMVLLGDGACGKTSALNVFTRGFFPTVYEPTVFENYVHDIFVDNVHMELSLWDTAGQEEFDRLRALSYEDTHVIMLCFSVDSPDSFENVATKWIDEIRENCPGVKLVLTALKCDLRKDDELNDNPNAITFEQGLAKAKEIGAVKYLECSAVQNRGIRETFYEAAKVALDVKPAGSSGSKGQCIIL

SEQ ID NO: 261 - DNA, 582 bp, Mus musculus
  CDS (1)..(582)
atggctgccatccggaagaaactggtgatcgtgggagatggagcttgtggaaaaacatgtttgctcatcgtcttcagcaaggaccagtttcctgaggtttacgtgcccacagtatttgagaactatgtggctgatatcgaagtggatggaaaacaggtggagttggccctgtgggatacagctggacaagaagattatgatcgcctgaggccactctcctatcccgacactgatgttctcttgttatgtttctccattggcaaccctgatagctttgggaacatcccacataaatggattccagaagtcaagcatttctgtcccaacgtgcccatcatcctggttgggagtaagaaggatcttcggaatgacttctacacgatacaagagttagccaagaggaagcaagcgcctgtgagacctgaacaaggccaagggttggcgaacagcattggcgctttcgagtatgtggagtgttcagcgaagaccaaagatggagtgaggagggtctttgaaaaggccacaagggctgctctgcaaacgaatcgagtgaagaaaaagactggttgctttgtcttttga

SEQ ID NO: 262 - protein, 193 aa, Mus musculus
MAAIRKKLVIVGDGACGKTCLLIVFSKDQFPEVYVPTVFENYVADIEVDGKQVELALWDTAGQEDYDRLRPLSYPDTDVLLLCFSIGNPDSFGNIPHKWIPEVKHFCPNVPIILVGSKKDLRNDFYTIQELAKRKQAPVRPEQGQGLANSIGAFEYVECSAKTKDGVRRVFEKATRAALQTNRVKKKTGCFVF

SEQ ID NO: 263 - DNA, 576 bp, Mus musculus
  CDS (1)..(576)
atgctgagctcaatcaagtgcgtgctggtaggggacagtgctgtggggaaaacctcactgttggtgcgcttcacctctgagaccttcccggaggcctacaaacccacggtgtacgagaatacgggtgtagacgtcttcatggatggcatccagatcagcctgggtctctgggacactgccggcaacgacgccttcagaagtatccggcccctgtcctaccagcaggcagacgtggtactgatgtgctactctgtggccaaccataactcgttcctgaacttgaagaacaaatggattagtgagatcaggagcaacctaccctgtaccccggtgctggttgtggccacacagacggaccagagagaggtgggacctcacagggcttcctgcatcaatgccatagaagggaagagacttgcccaggatgtgagagccaagggctacctggagtgctcagccctcagcaaccggggagtacagcaggtatttgaatgtgctgtccgaacagctgtcaaccaggccaggaggcgaaacagaaggaagctgttctccatcaatgaatgcaagatcttctaa

SEQ ID NO: 264 - protein, 191 aa, Mus musculus
MLSSIKCVLVGDSAVGKTSLLVRFTSETFPEAYKPTVYENTGVDVFMDGIQISLGLWDTAGNDAFRSIRPLSYQQADVVLMCYSVANHNSFLNLKNKWISEIRSNLPCTPVLVVATQTDQREVGPHRASCINAIEGKRLAQDVRAKGYLECSALSNRGVQQVFECAVRTAVNQARRRNRRKLFSINECKIF

SEQ ID NO: 265 - DNA, 786 bp, Mus musculus
  CDS (1)..(786)
atggccccgcagcaaggccggccggcgctgcccgcccgctgcgagccgccggcggcgccgccggtaccgcctcgccgagagcgcggggggcgcggggcgcgcgggcccggggtgtccgggggtcgggggcgcgcgggcggcgccgagggacgcggcgtcaagtgcgtgctggtcggcgacggcgcggtgggcaagaccagcctggtggtcagctacaccactaacggctaccccaccgagtacatccctacggccttcgacaacttctcggccgtggtgtctgtagatgggcggcctgtgagactccagctctgtgacactgcaggacaggatgagtttgacaagctgaggcccctctgctacaccaacacagacatcttcctgctgtgcttcagcgtggtgagccccacatccttccagaacgtgggcgagaagtgggttccagagattcgacgtcactgcccaaaggcccccatcatcctggtcgggacacagtcggacctcagggaggacgtcaaagtgctcatagaactggacaagtgcaaagagaagccggtgcctgaagaggcggcgaagctgtgcgcggaggaagtcaaagctgtctcctacatcgagtgctcagcgttgactcagaaaaacctcaaagaggttttcgacgccgccattgttgctggtatccagcactcagactcccagctacagccaaagaagtctaaaagcaggaccccggataaggtgcgggacctgtccaagtcttggtggaggaagtattgctgcctggcctga

SEQ ID NO: 266 - protein, 261 aa, Mus musculus
MAPQQGRPALPARCEPPAAPPVPPRRERGGRGARGPGVSGGRGRAGGAEGRGVKCVLVGDGAVGKTSLVVSYTTNGYPTEYIPTAFDNFSAVVSVDGRPVRLQLCDTAGQDEFDKLRPLCYTNTDIFLLCFSVVSPTSFQNVGEKWVPEIRRHCPKAPIILVGTQSDLREDVKVLIELDKCKEKPVPEEAAKLCAEEVKAVSYIECSALTQKNLKEVFDAAIVAGIQHSDSQLQPKKSKSRTPDKVRDLSKSWWRKYCCLA

SEQ ID NO: 267 - DNA, 624 bp, Trichoderma reesei
  CDS (1)..(624)
atgcctctctgcggcggctccaagacggtgcagcgcaagctggttcttctgggcgatggtgccagcggaaagacgtcgctgctcaacgtcttcacaagaggttactttcccaccgtctacgaacctaccgtctttgaaaattacgtccacgacatctttgtcgacaacgtccacatcgagctctccctctgggatacggcgggacaggaggaattcgatcggctgcgatcgctctcctacgatgacaccgatttgatcgtgctctgttactcggtcgatagcaaagactcgctagaaaacgtcgaatccaaatgggtcggagagattgccgacaactgccccggcgtcaagctggtcctcgtcgccctcaagtgcgacctgcgccagcaagaggacgacgagcccgaggaccaggcagcggccgacggcaacgcacagcgcgagaaaccgcccacgatttcctacgacgagggccttgaggtcgccaagcggataggcgcctcgcgctacctggagtgctcggcgatgaagaaccgcggcgtcaacgaggcctttaccgaggcggcccgcgtagcgctaagcgtcaagaaggagagggaagacaacaagtgcacaatcatgtaa

SEQ ID NO: 268 - protein, 207 aa, Trichoderma reesei
MPLCGGSKTVQRKLVLLGDGASGKTSLLNVFTRGYFPTVYEPTVFENYVHDIFVDNVHIELSLWDTAGQEEFDRLRSLSYDDTDLIVLCYSVDSKDSLENVESKWVGEIADNCPGVKLVLVALKCDLRQQEDDEPEDQAAADGNAQREKPPTISYDEGLEVAKRIGASRYLECSAMKNRGVNEAFTEAARVALSVKKEREDNKCTIM

SEQ ID NO: 269 - DNA, 675 bp, Ashbya gossypii
  CDS (1)..(675)
atgcctctgtgtgggtcgagctcgtcgtcgaagcatcctatcgagcgcaagatcgtcatcctcggagacggtgcttgcgggaagacgtcgctgttgaacgtgttcacgcgagggtactttccgaaggtgtacgagcccacggtattcgaaaactacatccatgacatcttcgtggacaaccagcacatcacgctgagcctgtgggacactgctgggcaggaggagtttgaccggttgcgatcgctgtcgtactcggacacacacacgattatgctgtgtttctcggtggactcgcgggactcgctggagaacgtcaagaacaagtgggtgagcgaaattgcggaccactgcgagggcgtgaagctggtgctagtggcgctgaagtgcgacttgcgcagcagcgacgagtacggcaacgagagcgccatcacgccggggtccatccagaaccagaagtacaacggcggcggcggcaacgggctgatcccctacgacgaggggctggcgatggccaagcagattggggcgctgcgctatctggagtgcagcgccaagatgaaccgtggcgtgaacgaggcgttcaccgaggctgcgcgctgcgcgctgactgcgacaccgaagggggcccgggactctgcgcccgaggccgaaagcagcagttgtactatcatgtga

SEQ ID NO: 270 - protein, 224 aa, Ashbya gossypii
MPLCGSSSSSKHPIERKIVILGDGACGKTSLLNVFTRGYFPKVYEPTVFENYIHDIFVDNQHITLSLWDTAGQEEFDRLRSLSYSDTHTIMLCFSVDSRDSLENVKNKWVSEIADHCEGVKLVLVALKCDLRSSDEYGNESAITPGSIQNQKYNGGGGNGLIPYDEGLAMAKQIGALRYLECSAKMNRGVNEAFTEAARCALTATPKGARDSAPEAESSSCTIM

SEQ ID NO: 271 - DNA, 624 bp, Ashbya gossypii
  CDS (1)..(624)
atgtctcagcaaatgcataaccccagtatcaggagaaaattggtgatcgtcggagatggtgcatgcgggaaaacatgtcttttgattgtgtttgccaagggaaagttcccacaggtgtatgttcctacggttttcgacaactacgttgcagatgtggaggtagacggcagacgggtggagcttgcgctttgggatacggctgggcaggaggattacgacaggctacggccgttatcgtacccagactccaatgttgtgttgatctgctactcgattgacctaccagactcgttggagaacgtgatggagaagtggatcagcgaggtgctatacttctgccagggtgttccgatcatcttggtggggtgcaaggctgacttgcggaacgatccgcaagtgatcgagcagttgagacagcagggacagcagcctgtctcgcaggctcaggcgcaggaggtagcggaccagatcggcgcggtagagtacattgagtgctctgcaaagaccggctttggtgtgcgcgaggtgtttgaggcggccacgcgtgcttccttgatggggaaacaaggcaagtctaaggcgaagtctgacaagaagaagaagaaaaagtgtgtggtcttgtag

SEQ ID NO: 272 - protein, 207 aa, Ashbya gossypii
MSQQMHNPSIRRKLVIVGDGACGKTCLLIVFAKGKFPQVYVPTVFDNYVADVEVDGRRVELALWDTAGQEDYDRLRPLSYPDSNVVLICYSIDLPDSLENVMEKWISEVLYFCQGVPIILVGCKADLRNDPQVIEQLRQQGQQPVSQAQAQEVADQIGAVEYIECSAKTGFGVREVFEAATRASLMGKQGKSKAKSDKKKKKKCVVL

SEQ ID NO: 273 - DNA, 615 bp, Yarrowia lipolytica
  CDS (1)..(615)
atgccccaaccaacggatctgcgaagaaaactcgtcattgtcggcgacggagcctgcggcaagacctgtctgctgattgtcttcgcgaagggcaccttcccggaggtgtacgtgcccaccgtgtttgagaactacgtggccgacgtggagattgacggccgacgagtggagctggccctgtgggataccgccggccaggaggattacgaccgactgcgacccctgtcctaccccgacgccaacgtcatcatcatctgcttcgccatcgacagccccgactcgctcgacaacgtgcaggagaagtggatctccgaggtgctgcacttttgccagggcgtgcctattctgctggtcggttgcaaggtcgacctgcgaaacgaccccaagaccatcgaggagctgagaagaacgtcccagcgacccgtcacgaccgaggagggaaatgccgtggcccagaagattggcgccggcaagtacctggagtgctctgcccgaacccacgacggagtgagagaggtcttcgagcatgccacccgagctgccctgactgcccacggccagaagggctccaagagctccagcagagagggcaagaaaaagtgtttgattttgtaa

SEQ ID NO: 274 - protein, 204 aa, Yarrowia lipolytica
MPQPTDLRRKLVIVGDGACGKTCLLIVFAKGTFPEVYVPTVFENYVADVEIDGRRVELALWDTAGQEDYDRLRPLSYPDANVIIICFAIDSPDSLDNVQEKWISEVLHFCQGVPILLVGCKVDLRNDPKTIEELRRTSQRPVTTEEGNAVAQKIGAGKYLECSARTHDGVREVFEHATRAALTAHGQKGSKSSSREGKKKCLIL

SEQ ID NO: 275 - DNA, 915 bp, Zea mays
  CDS (10)..(657)
gtcttggccatggcctccagcgcctcccggttcatcaagtgcgtcacagtgggggacggcgccgtgggaaagacctgcatgctcatctgctacaccagcaacaagttccccactgattacatacccactgtcttcgataacttcagtgcaaacgtggtagtcgacggtaccacggtgaatttgggcctttgggatactgcagggcaggaagattacaacagactgaggccactgagctaccgcggagcagatgtgttcgtgctcgccttctcgcttgtcagccgagctagctacgagaatgttatgaagaagtggctaccggagcttcagcattatgcaccgggtgtccccatagtgttggccggaactaaattggatcttcgtgaagacaggcactacttagttgaccatcctggtgcggtacctgttactacagcacagggggaggaactgcgcaagcacattggcgcaacttgctacatcgaatgcagctcaaaaactcagcagaatgtgaaagctgtgtttgatgctgccatcaaggtagtaatcaggcctccgacgaagcagcgagaaaggaagaaaaagaaagaacggcgaggatgctcaatattctgcagccgtatcatgcacgcaagaagactaggatgcttcaagtgatagaaggccttcttcgacgataacgtaggcttctaagatgaatcgagatcgtgtatagtttgtctccatgttccaaagtgctcgttgcgcttgtgcacttgggctggtaatgtgtatatttagtctttgccaattgatatttaggagaaatattaagcacttcgtttatgtaccattggctcataatgagctgggaagtccaatacatactaagaagtaacaatattttcttccgatgattttattatggtttctcgt

SEQ ID NO: 276 - protein, 215 aa, Zea mays
MASSASRFIKCVTVGDGAVGKTCMLICYTSNKFPTDYIPTVFDNFSANVVVDGTTVNLGLWDTAGQEDYNRLRPLSYRGADVFVLAFSLVSRASYENVMKKWLPELQHYAPGVPIVLAGTKLDLREDRHYLVDHPGAVPVTTAQGEELRKHIGATCYIECSSKTQQNVKAVFDAAIKVVIRPPTKQRERKKKKERRGCSIFCSRIMHARRLGCFK

SEQ ID NO: 277 - DNA, 1002 bp, Zea mays
  CDS (149)..(787)
agaagataagcaaagcaaggcaaccgttgtcgttgtctctgttcctccgcttcctgctctcttggcttgctgcttgccctcggagcagtgccttccgccgccgccgccgccgcctgttgtgagaaggagaggccggggctgggaggagatgagcgtgaccaagttcatcaagtgcgtcacggtgggggacggcgcggtgggcaagacctgcatgctcatctgctacaccagcaacaagttccccacggattacatccccacggtgttcgacaacttcagcgccaacgtctccgtggacggcagcatcgtcaacctgggcctctgggacactgcaggacaagaggactacagcagattgcggccactgagctacaggggcgcggacgtgttcgtgctggccttctccttgatcagcagggcgagctatgagaacgtccttaagaagtgggtgccagagcttcgcagattcgcgcccgacgtcccggtcgttcttgtcgggaccaagttagatctccgtgaccacagggcctaccttgctgaccatcctggagcgtcgacgatcacgacggcacagggcgaagaactgaggaggcagatcggcgctgcggcttacatcgagtgcagttccaaaacgcagcagaatgtcaagtcggtcttcgacacagccatcaaagtggtccttcagcccccgcggaggagggaggcgacgcctgccaggaggaagaacaggcgtggctccgggtgctctatcatgaacctcatgtgtggcagcacgtgcgctgcttaggagtctagaacactgatctggaaggaggtgaaggtgaaggcatggtgtctatgtgctatggcgactggcaagttaatggggccgcatggatgactgctgctcttgtttttttaagctcgtctgccgtatgctttgtttttttaggcttcaaggactgacaattgcaagaatgcagtgtttatgtaagaggttgtttgctggaataggattgctgt

SEQ ID NO: 278 - protein, 212 aa, Zea mays
MSVTKFIKCVTVGDGAVGKTCMLICYTSNKFPTDYIPTVFDNFSANVSVDGSIVNLGLWDTAGQEDYSRLRPLSYRGADVFVLAFSLISRASYENVLKKWVPELRRFAPDVPVVLVGTKLDLRDHRAYLADHPGASTITTAQGEELRRQIGAAAYIECSSKTQQNVKSVFDTAIKVVLQPPRRREATPARRKNRRGSGCSIMNLMCGSTCAA

SEQ ID NO: 279 - DNA, 850 bp, Oryza sativa
  CDS (112)..(705)
agcaagcagcagctgaggtgaggtccgtggcgttggagtgaggactgaggaggaagaagagggcgggatctagggtaccggatgcgctggctgtgctgagtgagagtagagatgagcgcgtctcggttcatcaagtgcgtcaccgtgggggacggcgccgtgggcaagacctgcatgctcatctcctacacctccaacaccttccccacggactatgttccaactgtttttgataacttcagtgcaaatgttgtggtcgatgggagcactgtgaacttggggttgtgggatacagcaggacaagaggactacaataggctacgcccgttgagctatcgtggcgctgatgttttcctgctggccttttctctgatcagcaaagcaagctatgagaatgtttctaaaaagtggatacctgaattaaggcattatgctcctggtgtgccaataattctcgttggaacaaagcttgatctgcgggatgataagcaatttttcgtagatcaccctggtgctgtacctatttccactgctcagggcgaagagctgaggaaactcattggtgcagcggcatacattgaatgcagttcaaaaacacagcaaaacatcaaggcagttttcgatgctgcgattaaggtggttctccagcctccaaagcaaaagaagaagaagaaaaaggcgcagaaaggatgtgccatcttgtaattaaatggtagacagtgcagtgcagatcgatgtatcccttcatttgtagcctctggcttcaatcgtcgcttgtttgtataattacgctagatgccaccggcagaagatataatatagtcctcctgcctttgtggtgttggtctct

SEQ ID NO: 280 - protein, 197 aa, Oryza sativa
MSASRFIKCVTVGDGAVGKTCMLISYTSNTFPTDYVPTVFDNFSANVVVDGSTVNLGLWDTAGQEDYNRLRPLSYRGADVFLLAFSLISKASYENVSKKWIPELRHYAPGVPIILVGTKLDLRDDKQFFVDHPGAVPISTAQGEELRKLIGAAAYIECSSKTQQNIKAVFDAAIKVVLQPPKQKKKKKKAQKGCAIL

SEQ ID NO: 281 - DNA, 800 bp, Suillus bovinus
  CDS (123)..(707)
ccgtcacgttgccttctaccatctttcaaagttaaaggttattcaagcactcgctgattctgcgcacacattgctctccttgagggcttctctttcaggcaaccaagtaggattcaatcagaatgcacaacatcaaatgtgttgtagtcggcgatggtgctgttggcaagacgtgtcttctcatctcttataccacaaatgcctttccaggagaatacgtgccaacagtattcgacaactactctgcaaatgtgatggtcgacgggaaaactatctctctcggtctatgggataccgctggacaagaagattacgatcgtctccggccactctcctaccctcaaacagatgtctttttgatctgtttctcgctcgtcagtccacctagctacgagaacgttagaaccaagtggtggcctgagatttcacatcatgcgccatctacttcggtggtcttggttggcactaaactggatttgcgtgaagatcctgctaccatcgagaaactccgtgaccggcgtatgcagcctatccagtacacgcaaggggtctcgatggcgagggatattggcgccgtcaagtatcttgaatgttctgcgctatcgcaaaagggcctaaagaccgtgtttgatgaggttatccgtgctgttttgaaccctcccccgaaggaaaagaagcgcagtggtcgtggttgtgttatcgtatgagtggatttgccattccacatgctcatatagatggattttctttgttttatcatatcacgcccatttatgttgttgcttctgttaaaaaaaaaa

SEQ ID NO: 282 - protein, 194 aa, Suillus bovinus
MHNIKCVVVGDGAVGKTCLLISYTTNAFPGEYVPTVFDNYSANVMVDGKTISLGLWDTAGQEDYDRLRPLSYPQTDVFLICFSLVSPPSYENVRTKWWPEISHHAPSTSVVLVGTKLDLREDPATIEKLRDRRMQPIQYTQGVSMARDIGAVKYLECSALSQKGLKTVFDEVIRAVLNPPPKEKKRSGRGCVIV

SEQ ID NO: 283 - DNA, 1065 bp, Suillus bovinus
  CDS (170)..(745)
gccaacatcgacaccgtactttctcatttcttctaccgacgtcctgttcgtaaattagagtcaaccttctctgtcgtgattgggttaatagcatttcctcgcttcaactctcctccttgaattttccggaagaatcgccaagtttatcacgtagaaccatctcaacgacatgcagactatcaaggttgtagtggtgggggacggtgctgtaggcaagacttgtttgttgatctcatacaccacgaacaaatttccaagcgactatgttccgactgtcttcgataactacgctgtcactgtaatgattggtgaagatccttacacactaggtcttttcgacaccgccgggcaagaggattatgaccgtctccggccactgtcatacccccaaaccgacgtcttccttgtttgctttagtgtaacgtcccctccatccttcgagaacgtgagggagaaatggattccggaggtacaccatcattgtccgggtgtcccatgtcttatcgttgggacgcaaatcgatttgcgggacgacgctcaagtgattgagaagctctccaggcagaagcaacgaccggtgccgaccgagcacggcgagaggctttccagagagcttggtgccgtcaagtacgtggagtgctcagccctgacgcagaaagggttgaagaacgtcttcgacgaggctattgtcgctgcgctagagccacccgtggttaagaagacacataaatgcgtcgtcgtttaatgaatgatccatcacgacggtacagcttgttttatcttcttatgactcctttacgccttgttctgcctcatatatccttctcatctttttttatgtcgtttctctcgttgcgccaagacatcatgattttccctagtcctgttgcatctgttctcttccgcacgagctgagtggacttgagctatctcgtgctcttaaagaagctgatctcatccgtctttctacaccacaattgatgactagttcgtattgttggaactgttgggtttgataggaatttaatacccatgacggggacttgtcatgtcaaaaaaaaaaaa

SEQ ID NO: 284 - protein, 191 aa, Suillus bovinus
MQTIKVVVVGDGAVGKTCLLISYTTNKFPSDYVPTVFDNYAVTVMIGEDPYTLGLFDTAGQEDYDRLRPLSYPQTDVFLVCFSVTSPPSFENVREKWIPEVHHHCPGVPCLIVGTQIDLRDDAQVIEKLSRQKQRPVPTEHGERLSRELGAVKYVECSALTQKGLKNVFDEAIVAALEPPVVKKTHKCVVV

SEQ ID NO: 285 - DNA, 576 bp, Yarrowia lipolytica
  CDS (1)..(576)
atgcagaccataaaatgtgttgttgtcggcgatggtgccgtcggaaagacttgtctcctcatctcatacacaacaaacaagttcccctctgaatacgttcccaccgtttttgacaactatgccgtgactgtcatgattggagacgagccctacacactcggactgttcgacaccgccggtcaggaggattacgaccgactgcgacctctttgttaccctcagaccgatgttttcctcgtctgcttttccgtcacctctcccgcctcctttgagaacgtcaaggagaagtggttccctgaggtccaccaccactgccccggcgtgccttgcctcattgttggtacccaggttgatccgcgaagtgacaggatgattcttgacaagctttcccgacacaagctgcgacccatgaccactgagcaaggctaccagctcgcccgagaactcggtgccgtcaagtacgtcgagtgttctgcccttactcagaagggtctcaaggacgttttcgacgaggccatcgtggcagctcttgagcctccagtggtcaagaagaacaaaaagtgcattgtgctctag

SEQ ID NO: 286 - protein, 191 aa, Yarrowia lipolytica
MQTIKCVVVGDGAVGKTCLLISYTTNKFPSEYVPTVFDNYAVTVMIGDEPYTLGLFDTAGQEDYDRLRPLCYPQTDVFLVCFSVTSPASFENVKEKWFPEVHHHCPGVPCLIVGTQVDPRSDRMILDKLSRHKLRPMTTEQGYQLARELGAVKYVECSALTQKGLKDVFDEAIVAALEPPVVKKNKKCIVL

SEQ ID NO: 287 - DNA, 1157 bp, Ashbya gossypii
  CDS (192)..(971)
gcaagagccttaaatcacctgcatcccccgatttcaacacccttgttagaaagaggtaaacagatcaccacggcgccagtaggtgaaaatcggcaggcagtgggtggcgttcaggacgcggcaaggaagggcagtggaagcaatcgcggtcggtttagcgggacagcgcgtcaagaggcagacagaacgaaatgagcgcagggccgttgcaagctgcgccaaagaagaattacggagcactgataggcgcggggccggcggtgggcggggcggcattcaaccggacgctgagcgaggttgcgagctacgagcgcagccggcgcgaccacgcgacgccggactaccggatcaagatcgtggtggtgggggacggcgcgacggggaagacgtctctgctgatgtcgtacacacagggccagttcccagaggactacgtgccgaccatcttcgagaactacgtgacgaacattgagggcccacgcgggaaggtgatcgagctggcgctgtgggacactgctgggcaggaggagtacagccggctgcggccgctgtcttacggggacgtggacatcgtgatggtgtgctacgcggcagacaaccgcacgtcgctgacgaacgcggaagagctgtggttcccggaggtgcgccacttctgcccgcacgcgccgatgatgctggtggggctcaagagcgacctgtactcgcttgatgcgctggaccggctcgtggacccgacggacgcggaactggtggcgcgcaagatgggcgccttcgtgcacctgcagtgctcggccaagacgcgacagtgcctggaggacgtgttcaacacggcgatacacacggcgctgtacgacgagctgcgcgcgcccccgcagcgcggggtgaagggcatgttcaagaagaagcagcagcgggacccgcaggcgcagtcttacaagcgggtgcgcaagcaccgctgtgtggtcctatagcgcacgtgacagccatgtttcgccggccctggttcctggcagcggaggcgcaagcgccgcgccggcgcgcctagtccgctgtcgaggcctgcgtgaccgtgtagttaggcatctagtcgtagcgagccaagatgttagtttaaatcgatcggtgcgacagcatcttgttaggatagagtactggga

SEQ ID NO: 288 - protein, 259 aa, Ashbya gossypii
MSAGPLQAAPKKNYGALIGAGPAVGGAAFNRTLSEVASYERSRRDHATPDYRIKIVVVGDGATGKTSLLMSYTQGQFPEDYVPTIFENYVTNIEGPRGKVIELALWDTAGQEEYSRLRPLSYGDVDIVMVCYAADNRTSLTNAEELWFPEVRHFCPHAPMMLVGLKSDLYSLDALDRLVDPTDAELVARKMGAFVHLQCSAKTRQCLEDVFNTAIHTALYDELRAPPQRGVKGMFKKKQQRDPQAQSYKRVRKHRCVVL

SEQ ID NO: 289 - DNA, 1067 bp, Oryza sativa
  CDS (131)..(775)
  MISC_FEATURE (957)..(957): n is a, t, g, or c
aagaacgaacaactcttctccccctctccccctccttccttgctcctcctcccatcttgtctcctccctctctctcgcaaagtcgcaacgcgctcctcctcggtgaaacgggagtgaggtgcgtgcggccatggcgtccagcgcctcccggttcatcaagtgcgtcacggtgggcgacggcgccgtgggcaagacctgcatgctcatctgctacaccagcaacaagttccccactgactacataccaacggtgttcgacaatttcagcgcaaacgttgttgtggacagcaccacggtgaatctgggcctctgggatactgctgggcaagaggattacaaccggctcaggcctctgagctatcgtggtgctgatgttttcgtgcttgccttctctcttgtgagccgagctagctatgaaaatattatgaagaagtggataccggagctacagcattatgcacccggcgtgcccattgtgttggttggcacaaaattggatctccgtgaagacaagcactacttgttggaccatcctggcatgatacctgttaccacagcacagggtgaagaacttcgaaaacaaataggtgctgcttattacattgagtgcagctcaaagacacaacagaatgtcaaaggtgtgtttgatgctgctatcaaggtagtaatccagcctccaactaagcagagggaaaagaagaaaaagaaatcacgacaaggatgctctatgatgaacatgttccgtggaaggaaaatgtcatgcttcaaatcctgattgatcgagatgtcccttacatgatgcaatgttctgggtgcaacctcaagctggcaacctttggagtctgaatgtgctggtagagttagatgcaaagttcttgtgtatatttgcatcttttggtaattaattactagagttagatggttaaactagtctgcttatgtaccgcacaatgcttnttattattagctcttgttggtctagaaagtctgatagatgccaaaggaacaaggagacaccgttctgtcaggacaaaatcacagattttgtaatcaaaaaaaaaaaaaaa

SEQ ID NO: 290 - protein, 214 aa, Oryza sativa
MASSASRFIKCVTVGDGAVGKTCMLICYTSNKFPTDYIPTVFDNFSANVVVDSTTVNLGLWDTAGQEDYNRLRPLSYRGADVFVLAFSLVSRASYENIMKKWIPELQHYAPGVPIVLVGTKLDLREDKHYLLDHPGMIPVTTAQGEELRKQIGAAYYIECSSKTQQNVKGVFDAAIKVVIQPPTKQREKKKKKSRQGCSMMNMFRGRKMSCFKS

SEQ ID NO: 291 - DNA, 1087 bp, Oryza sativa
  CDS (141)..(785)
aacaaagcagcttgccaccgtccctgcctctcctgctttgctttgccttctcggagaagacaaatctactgtagctgcttgtctctgttcgccggtggcgaccgtgagaggaggaggtagtcctagtcctagtaggcgagatgagcggcgccaccaagttcatcaagtgcgtcaccgtcggcgacggcgccgtcggcaagacctgcatgctcatctgctacaccagcaacaagttccccaccgattacatccccaccgtgttcgacaacttcagtgctaatgtttcagtggatgggaacatcgtcaacttgggattatgggacactgctggacaagaggattacagcaggctgaggccactgagctacaggggagcggatatatttgtgctggcattctcactgatcagcagagcaagctatgagaatgttctcaagaagtggatgccggagcttcgccggttcgcaccgaatgttccaattgttcttgttgggaccaagttagatctacgtgaccacagatcttaccttgcggaccatcctgctgcttccgcaattacgactgcacagggtgaagaacttagaaagcagataggcgccgcggcctacatcgaatgcagttcgaaaacacaacagaacatcaaggccgtgtttgatactgccatcaaggtggtccttcagcctcctcggagaaggggggagacgacgatggcaaggaagaagacaaggcgaagcaccggctgctcgttaaagaacttgatgtgtggcagtgcatgtgttgtttaggacctgtctgaattcttgaaggtgtgtaagcgttgtgtaatggcaagtgaatttgctgactgttctgctgcttccatttactactactaagctctttcgtgtgtttgaattactacatctaaaactagagcatcaggctcatagactgacttcatatcaggtgtttgtatcattaatattattatgtaagaaggttgtggtttgtggaacaactaaatacaacaatgcaggctatgttgtactatgctctgctactggtgtttgttataaatatcacatcctgctaaaaaaaaaaaaaaaaa

SEQ ID NO: 292 - protein, 214 aa, Oryza sativa
MSGATKFIKCVTVGDGAVGKTCMLICYTSNKFPTDYIPTVFDNFSANVSVDGNIVNLGLWDTAGQEDYSRLRPLSYRGADIFVLAFSLISRASYENVLKKWMPELRRFAPNVPIVLVGTKLDLRDHRSYLADHPAASAITTAQGEELRKQIGAAAYIECSSKTQQNIKAVFDTAIKVVLQPPRRRGETTMARKKTRRSTGCSLKNLMCGSACVV

SEQ ID NO: 293 - DNA, 1059 bp, Cicer arietinum
  CDS (118)..(711)
cttcttcatcccttcttcttgatcattcattcgttcattcaccaagttcgaacttgaacgcacaacagcattaccacatgagtaattagggtttatacagcaacaagaaacataaaaatgagtgggtccaggttcattaagtgtgttaccgtaggtgacggtgccgtaggcaagacttgtttgcttatctcctacaccagcaacactttccctacggactatgtgcctactgtctttgataatttcagtgcaaatgtagttgtggatgggagcactataaatctgggtttgtgggatactgctggccaagaagattacaatagattaagacccttaagctatcgtggagcggatgttttcctgcttgctttctcactcataagcagggccagctatgaaaatatcgccaagaaatggattcctgagttgaggcattatgctcctggtgttccaattattctcgttggaacaaaacttgatcttcgggatgataagcaattctttcaagaccatcctggtgcggtgccaatcaccacagcacagggtgaggaactgagaaagcttattggtgctccagtttacattgaatgtagttccaaaacacaaaagaatgtgaaggctgtttttgatgcggccatcaaagtagttctacagccgccaaagcaaaagaaaactaagagaaaggggcaaaaagcctgttccattttgtgatcttcagttcttcatattgtagttggtggagaggacgacatgatagtaaccatttcctggtagtctttgccattctgattctatatcttaccctattttcaacctacatggaggaatcgacgtgtccaactgagtcctaactacataaggtttgcttataagcatcaagctatttgtctctggctgaaggatatatgtaaagtcataatttcaaacatgtttggtgtgtagaacaactcttgtgtttctctgggatgtttttacctgttgtattgattattaaatgaccatctccaattgtggacatgggttttactcacattgtaatctaatctaggaagtgcttgc

SEQ ID NO: 294 - protein, 197 aa, Cicer arietinum
MSGSRFIKCVTVGDGAVGKTCLLISYTSNTFPTDYVPTVFDNFSANVVVDGSTINLGLWDTAGQEDYNRLRPLSYRGADVFLLAFSLISRASYENIAKKWIPELRHYAPGVPIILVGTKLDLRDDKQFFQDHPGAVPITTAQGEELRKLIGAPVYIECSSKTQKNVKAVFDAAIKVVLQPPKQKKTKRKGQKACSIL

SEQ ID NO: 295 - DNA, 805 bp, Wuchereria bancrofti
  CDS (26)..(601)
cggcacgagcaagtttgaggtaaagatgcagactatcaaatgtgtagtggttggagatggtgctgtcggcaaaacatgccttcttatttcgtatactaccaacaagtttcccagtgaatatgtacccactgtatttgacaattatgctgtaacagtaatgattggaggagaaccatatacgcttggtttgttcgatacagccggtcaagaggattatgatagattgcgtcctctttcatatccgcaaacagatgtatttttagtgtgcttttctgtcgttgcaccttcatctttcgaaaatgtgaaagagaagtgggtgccggagatagcacatcactgcatgaagacaccgttcctgctggtcggaactcagattgatcttcgtgacgatccttcctacatcgaaaaattggcaaaaatcaagcaacgaccaattacattcgaagttggagagaagttagcgaaagaattaaaggcagtgaaatacgtcgaatgttctgcactcacacagaaaggtctaaaaaatgtatttgatgaagcaatactggcagcattggaaccaccggcacaggagaaaaagaagaaatgtactatactttagcatcattgtttctcgatcacgttatattgatttctgatttgttagtcatttatctgtaaatgattatgttaacgtcttaaatgctgcacataccattactacgtcccctcttctggttggtccatctgcgcatatgtgtagtgtttccatctatgcgatatacgtgtagaatgaatgtattcctgtacaaaaaaaaaaaaaaaa

SEQ ID NO: 296 - protein, 191 aa, Wuchereria bancrofti
MQTIKCVVVGDGAVGKTCLLISYTTNKFPSEYVPTVFDNYAVTVMIGGEPYTLGLFDTAGQEDYDRLRPLSYPQTDVFLVCFSVVAPSSFENVKEKWVPEIAHHCMKTPFLLVGTQIDLRDDPSYIEKLAKIKQRPITFEVGEKLAKELKAVKYVECSALTQKGLKNVFDEAILAALEPPAQEKKKKCTIL

SEQ ID NO: 297 - DNA, 579 bp, Emericella nidulans
  CDS (1)..(579)
atggtcgtagcaactatcaagtgtgttgtggtcggtgatggtgctgtcgggaagacctgtctcctgatctcatacacaacgaacaaattcccttcagaatatgtgcccaccgtgttcgataactatgctgtgactgtcatgatcggcgatgagccctacactctaggattatttgatactgctggtcaagaagattatgaccgacttcgtcctctctcatacccgcagacagatgtattccttgtctgcttttctgtgacctcccccgcatctttcgagaacgtgcgcgaaaagtggttccccgaagttcaccaccactgccccggcgtcccatgcctgattgttgggacacaagtcgatctccgggatgaccccgccgttcgcgacaagctggctcggcaaaagatgcaaccgattcgcaaagaagacggtgaccgcatggccaaggatctgggcgccgtgaaatatgtcgaatgctccgcattgacccaatacaagctcaaggatgtctttgacgaggctattgttgcggcactcgaaccggcccctaagaagaggtcgaggtgcgttctgctatag

SEQ ID NO: 298 - protein, 192 aa, Emericella nidulans
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQVDLRDDPAVRDKLARQKMQPIRKEDGDRMAKDLGAVKYVECSALTQYKLKDVFDEAIVAALEPAPKKRSRCVLL

SEQ ID NO: 299 - DNA, 588 bp, Drosophila melanogaster
  CDS (1)..(588)
atgtcaaccggaaggcccataaagtgtgtagtcgttggtgacggcaccgtcggaaagacctgcatgctaatctcctacacgacagactgctttcccggcgaatatgtgcccacagtcttcgacaactactcggcgcccatgcaagtggacacaatacaggtctcgctgggactgtgggatacggcgggtcaggaggactacgaccgcctgagaccgctatcctacccgcagacagacgttttcctgatatgctacagcgtggcgagtccctcgtcctttgagaacgtcacctcgaaatggtatccggagataaagcaccactgtcccgatgcgcccatcattctagttggcaccaaaatcgatttgcgcgaagatcgagagacactcagcggcctggcagagcagggactgacgccgctgaagcgcgagcagggccagaagctggcaaacaagatacgcgctgtgaaatacatggagtgctccgccttgacgcagcgcggtctcaagccggtgttcgaggaagcggtgcgcgcggtgctcagaccagagccgctaaagcgacgccagcgaaagtgtttaataatgtaa

SEQ ID NO: 300 - protein, 195 aa, Drosophila melanogaster
MSTGRPIKCVVVGDGTVGKTCMLISYTTDCFPGEYVPTVFDNYSAPMQVDTIQVSLGLWDTAGQEDYDRLRPLSYPQTDVFLICYSVASPSSFENVTSKWYPEIKHHCPDAPIILVGTKIDLREDRETLSGLAEQGLTPLKREQGQKLANKIRAVKYMECSALTQRGLKPVFEEAVRAVLRPEPLKRRQRKCLIM

SEQ ID NO: 301 - DNA, 582 bp, Xenopus laevis
  CDS (1)..(582)
atggcagccattcgtaagaagctcgtaattgttggagatggtgcatgcgggaaaacctgccttctgattgtgttcagtaaagaccagtttccagaagtgtatgtcccaacagtttttgagaactatgtggcagacatagaagtggatggcaagcaggttgagttggccctatgggatacagctggtcaagaagattatgacagactgcgacctctgtcctatccagacactgatgttatattaatgtgcttttccattgatagccccgacagtttagaaaacatacctgagaaatggaccccggaggtgaaacatttctgccccaatgtgcccattattttagttggaaacaagaaggatctgcgtaatgatgaacacactcgtagggagctcaccaaaatgaaacaggagcctgtgaagcccgaagaaggtcgtgacatggcaaaccgtatctccgcctacgcgtacatggaatgctctgcaaaaacgaaagatggcgtgagggaagtgtttgagctggctacacgggcagccctgcaagctaggcgtggcaagaagaaaccacgttgccttctcatctaa

SEQ ID NO: 302 - protein, 193 aa, Xenopus laevis
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNKKDLRNDEHTRRELTKMKQEPVKPEEGRDMANRISAYAYMECSAKTKDGVREVFELATRAALQARRGKKKPRCLLI

SEQ ID NO: 303 - DNA, 591 bp, Physcomitrella patens
  CDS (1)..(591)
atgagcacttcacggtttatcaagtgcgtgactgttggagatggagctgtcgggaagacgtgcatgcttatttcatacaccagcaacacatttcctactgattacgttcctaccgtgtttgacaacttcagcgcaaatgtagtggtcgatggaaataccgtcaacctcgggttatgggatacagcaggtcaagaagattacaacaggcttcgtcctctgagttacaggggtgctgatgtttttctcctggcgttctccctcatcagcaaggctagttatgaaaacatatcaaagaagtggatcccggaactgagacattacgcgccatctgtgccaatcattctcgtcggaacaaaacttgatcttcgcgatgacaaacaattctttgctgatcatcctggagcggctccaataactacttctcaaggggaggagctcaggaagtcgattggggcggcctcgtacatagagtgcagctcaaagactcagcagaatgtaaaagcagtttttgacgcagcaatcaaggtggttctccaaccaccaaagcagaagaagaagaagaaaaaacaaaagaattgcgtcattctgtga

SEQ ID NO: 304 - protein, 196 aa, Physcomitrella patens
MSTSRFIKCVTVGDGAVGKTCMLISYTSNTFPTDYVPTVFDNFSANVVVDGNTVNLGLWDTAGQEDYNRLRPLSYRGADVFLLAFSLISKASYENISKKWIPELRHYAPSVPIILVGTKLDLRDDKQFFADHPGAAPITTSQGEELRKSIGAASYIECSSKTQQNVKAVFDAAIKVVLQPPKQKKKKKKQKNCVIL

SEQ ID NO: 305 - DNA, 841 bp, Schistosoma mansoni
  CDS (7)..(588)
gcaacaatggcgagtgcggtacgtaagaaacttgttattgttggagatggtgcatgcgggaaaacttgtttacttattgtattcagcaaagaccagtttcccgaagtttacgttcctactgtattcgaaaactatgttgcagatatcgaagttgataacagacaagttgaattagctctctgggacactgctggccaagaagattatgataggctacggccactttcttatcctgatacggatgtagttctgttatgttatagtattgactctcccgatagttttgcaaacattgaggaaaaatggttaccagaaatccgtcatttttgtcctgatgttcccattgtcttagttggaaacaaaaaagacttacgacatgacgaggctacaaagaatgagctacacagaaccaaacaacttcctgtcacttttaacgagggtaaacaagtagctgaaaagatttctgcttatgccttctttgagtgttcagctaagaccaaggaaggagtcagcgatgttttcgtagcagctactcgagccgccttgaattcagcgaagaagaagaggaggaggtgtgatttaatttgatctccactgttctctaaattgtctagatttgattttccggtctccgaaacatacattcccctcctaattcttcctcaggaccttaaattgctacttctatcggctgcgtgtttcttttacaatcatattttttgtttgccaacaagacaatccattccacggaaatatttgccatttatttttgccttggtactaaaatagggcatgcctcatgtaacttatatttattgagaataaattactataatcagtc

SEQ ID NO: 306 - protein, 193 aa, Schistosoma mansoni
MASAVRKKLVIVGDGACGKTCLLIVFSKDQFPEVYVPTVFENYVADIEVDNRQVELALWDTAGQEDYDRLRPLSYPDTDVVLLCYSIDSPDSFANIEEKWLPEIRHFCPDVPIVLVGNKKDLRHDEATKNELHRTKQLPVTFNEGKQVAEKISAYAFFECSAKTKEGVSDVFVAATRAALNSAKKKRRRCDLI

SEQ ID NO: 307 - DNA, 576 bp, Gallus gallus
  CDS (1)..(576)
atgcagacgattaagtgtgtagttgtgggtgatggtgctgttggtaaaacctgtctcttaatttcttacacaacaaataaatttccatcggaatacgtaccaacggtttttgataactatgctgtaacagtgatgattggaggagagccttacactctaggcctctttgatactgcaggtcaggaagattatgatagattacgacccctcagctatccacagacagatgtatttctggtctgtttttcagtggtatctccttcttcatttgaaaatgtgaaagaaaagtgggtacctgaaattactcaccattgtccaaagactccttttctgcttgttgggacccaaattgatctaagagatgatccctcaacaattgaaaaacttgccaagaacaagcagaagcccataactccagagacggctgaaaaactggcccgggacctgaaggctgttaaatatgtggaatgctctgcgcttacgcagaaaggcctaaagaatgtatttgatgaggcgatattggctgccctggagcctccggagccgaagaagactcgcaggtgtgtgctgctatga

SEQ ID NO: 308 - protein, 191 aa, Gallus gallus
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQKGLKNVFDEAILAALEPPEPKKTRRCVLL

SEQ ID NO: 309 - DNA, 2011 bp, Candida albicans
  CDS (540)..(1580)
tctagatttccttactgtaaatcttaaggatcttcaatgatctatccctaacttcaattatagttcacaatacgctatgacgagcatctaaactatgtcaatatctgaaaaggctaattttttgttttgttttaaagcactttgtgattttaaggatattttccttaaatattatttttagaaataaatacagggacgactgattggaaataataaaacataaacactgcccatttcaggcacgcaaaaaaacaaaaaaaccgtgcccttttctttttcatgttttcctttcccgattttttctctctctctttatttctttctctctagattttttttactgatctcacactatcaccacatatacacactcacacattatataatcttcaattataactcatctgggttctaacagtttctttttttttctaacttgctttttttttaataaagtttctataatttcgatacaccaattttgttttcactatttagttattgtaacgttctagtttgaaaatccatttctataagatatgacacccaacggcagtaggagacattcggcgtacatggggtcgcccagaagccagcatagttccacaatggaaacaggttacaatccttacgaagcagtacagaagaaacaggaattataccaaaataacaacggcaattcaccaaccgtcatcattgaagaagatccatacatcccaaattataaagagctgtctctagcaaataagaaaacaaattataacatgaaaattgtcgttgtcggtgacggtgggtgtggtaagacgtgtttattattagcatacacacaaaacaaatttccttcaatctatgttcccacagtttttgagaattatgtgacggcagtacagtcgcctaatggtaaaaccgtggaattggctctctgggatactgctggccaagaagaatacgataggttacgaccactaagctatcctgacgttgatattttattggtgtgttttgccgtggacaatgaagttagtttggagaatgtcaaggatatgtggttccccgaagtgaatcattattgtcctggtattcccattattttggttggtaccaagagtgatttactgtctgatatgaatcacgatgcatcaatacgagtagccaaagaaattggcgccattggattgattttcacatcagccaagaccatgttcaatgtacggactgtttttaattttgcattaaaccattttcaaagaaatatggaattgcaggaacaatatgaaaagacattgggttcaagaaagagaataagtagagtattgggtggtagtaatggaggcagtgggaaccattccagacatcattctagaaactactccaacgtttcgaacaacagaaggggccatttgaagaacacatcatacgattccacggcattgttggatcaaccgttgacagaagacacctatgtgaaaaatccttatgggaactttggctataaagcaaatgttgaaagtccgtataatcaggatgagtttgcatttacaagagaaagaaagaagaagaaaaagtgtgtaatattgtagatacctctttgattaggtccataataatatattaaagttctgcatatgacaagaaatcgttttgtagaaagcacatgaaatcatgtcacaattgcatggctagtttacaggtctctggatttcgaattggatgaaagtataattataaaaccaattagtgtctgggaatactacataactgtctactgagatttcctatagtgagatatctaactggtcaaagtgtagtacttttgaagtgatattgggttacttgctgtatatatcgtcaatgttccgtttatccttcttatccgagactagtatagcaattattatcattaatccttaacaaatgaacaggctccagcttgtcgaaaaaacactgggcacttcatcattttgtagtggtaaatctttatattggtttccaatattatagatcctctaga

SEQ ID NO: 310 - protein, 346 aa, Candida albicans
MTPNGSRRHSAYMGSPRSQHSSTMETGYNPYEAVQKKQELYQNNNGNSPTVIIEEDPYIPNYKELSLANKKTNYNMKIVVVGDGGCGKTCLLLAYTQNKFPSIYVPTVFENYVTAVQSPNGKTVELALWDTAGQEEYDRLRPLSYPDVDILLVCFAVDNEVSLENVKDMWFPEVNHYCPGIPIILVGTKSDLLSDMNHDASIRVAKEIGAIGLIFTSAKTMFNVRTVFNFALNHFQRNMELQEQYEKTLGSRKRISRVLGGSNGGSGNHSRHHSRNYSNVSNNRRGHLKNTSYDSTALLDQPLTEDTYVKNPYGNFGYKANVESPYNQDEFAFTRERKKKKKCVIL

SEQ ID NO: 311 - DNA, 710 bp, Beta vulgaris
  CDS (91)..(684)
ttgattgatcaagaggagaagagagagtgagaggttgtttgaatagaagatcgttagatatttttttttttaattttttttgttaaaaaaatgagtgcttcgaggttcataaaatgtgttacagttggtgatggtgccgttggtaaaacttgcttgttgatttcttacaccagcaacacctttcctacggactacgtgcccactgtttttgacaatttcagtgccaatgtcgtcgttaacggggccacagttaatctgggattatgggatactgcaggacaagaggattataacagattaagacctttgagttatcgtggagcagatgtttttattctcgctttctcccttattagcaaggctagttatgaaaatgtttctaagaagtggattcctgagttgaagcattatgctcctggtgtccccattgttcttgttggaacaaagctcgatcttcgggatgacaagcagttttttatcgaccaccctggtgcagttccaatcactacagctcagggagaggaattaaggaaactgattggggctcctgcttacatcgaatgcagttcaaaaacacagcagaatgtcaaggcagtttttgatgcagccattaaggtcgtgcttcaaccaccaaagacaaagaaaaagaagtcaaaggcacagaaggcttgctccatattgtaattgtgtaagttgtaaagagaaacaag

SEQ ID NO: 312 - protein, 197 aa, Beta vulgaris
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIVLVGTKLDLRDDKQFFIDHPGAVPITTAQGEELRKLIGAPAYIECSSKTQQNVKAVFDAAIKVVLQPPKTKKKKSKAQKACSIL

SEQ ID NO: 313 - DNA, 581 bp, Cavia porcellus
atgcaggccatcaagtgtgtggtggtgggagatggagctgtgggcaagacctgcctccttatcagctacaccaccaacgccttccccggagagtacatccccaccgtgtttgacaactattcagccaatgtgatggtggacagcaagcccgtgaacctggggctgtgggacacagctggccaggaggactatgaccgcctgcgaccgctctcctacccacagacggacgtcttcctcatctgcttctccctcgtcagtccggcctcctatgagaatgtccatgccaattggtaccccaaagtgcggcaccactgccccagcacccccatcatcctgttgggcaccaagctggacctgcgggatgacaaggagaccatcgagaagctgaaggagaagaagctggcgcccatcacctacccacagggcctggcactggccaaggagattgactctgtgaagtacctggagtgctcagccctcacccagagaggcctgaagaccgtctttgacgaggccatccgtgccgtcctgtgccctcagcccacgcggccacagaagcgcgcctgcagcctcctctatag

SEQ ID NO: 314 - protein, 192 aa, Cavia porcellus
MQAIKCVVVGDGAVGKTCLLISYTTNAFPGEYIPTVFDNYSANVMVDSKPVNLGLWDTAGQEDYDRLRPLSYPQTDVFLICFSLVSPASYENVHANWYPKVRHHCPSTPIILLGTKLDLRDDKETIEKLKEKKLAPITYPQGLALAKEIDSVKYLECSALTQRGLKTVFDEAIRAVLCPQPTRPQKRACSLL

SEQ ID NO: 315 - DNA, 982 bp, Lotus japonicus
  CDS (113)..(703)
attttgtgtgtctcactctttttcgcttgttctatttttagtttcaagtgaaagaaatatggaaagctttgctgtaaggtaaggaaaatcagttcagaaaaggaggttgaaaatgagcacagctagattcatcaagtgtgttactgttggagatggagcagtgggaaagacctgtatgcttatctcttacaccagcaacacattcccaacggattatgtgcctactgtttttgataacttcagtgcaaatgtggtggttgatggcagcacagttaacctgggattatgggacactgctggacaggaggattacaataggcttaggcctttgagctacagaggagcagatgtgttcttgctggctttttccctccttagcagagccagctatgaaaatatctccaaaaagtggattcctgaactgagacactatgccccaactgtgccaattgttcttgtgggaaccaaacttgatttgagggaagacaggcagtatttgattgatcatcctggagccacacctattactactgcccagggagaagagctgaagaaggcaattggtgctgctgtgtacctagaatgcagctcaaagactcaacagaatgtgaaggctgtgtttgatgctgctatcaaggttgttttgcagccacctaaaccaaagaaaaaacgaaagaagaccagaccatgcgttttcctttaattgatgttcatgtttgattcgcaatctgtagcattcgggaccttcttcctatgttttttaccctttatttgattgcacaaatatgctttttgaacatatgtattacacactcttatcttctttccgttttcttgtattttttgttggtgggtctaagtgatatttcaatgtatctactggaacaaacaaggagactgtactcgatcaaagataaattttgtgataagaaataatagcattcatagtgactttttttattaaaaaaaaaaaaaaaaaaaa

SEQ ID NO: 316 - protein, 196 aa, Lotus japonicus
MSTARFIKCVTVGDGAVGKTCMLISYTSNTFPTDYVPTVFDNFSANVVVDGSTVNLGLWDTAGQEDYNRLRPLSYRGADVFLLAFSLLSRASYENISKKWIPELRHYAPTVPIVLVGTKLDLREDRQYLIDHPGATPITTAQGEELKKAIGAAVYLECSSKTQQNVKAVFDAAIKVVLQPPKPKKKRKKTRPCVFL

SEQ ID NO: 317 - DNA, 659 bp, Dictyostelium discoideum
  CDS (22)..(609)
ggttaaaaagtttacataatcatgcaatcaattaaattggtggtagtaggtgatggtgctgttggtaaaacttgtttattaatttcttatacatcaaattctttcccaacagaatacgttccaactgtatttgataactattcagcaaatgttatggtagataataaaactgtttcattaggtctttgggatactgctggtcaagaggattatgatcgtttaagaccactttcatacccacaaaccgatgtttttcttatttgtttcgctattataagtcaaacttcatatacaaatgtaaaatctaaatggtggcctgaagtcacacatcattgtccaaactgcacaattattttagttggtacaaaatgtgatttaagagaagacaaagaaagtttagaaaaactcagagaaaaacatcaacaaccactcaccttccaacaaggtgaacaaatggcaaaagaaattaaagccttttgttatatggaatgttccgctttaactcaaaaaggtctcaaacaagttttcgacgaagctattaaagctgttattttcccagatagagataaggccacaaacaaaaagaattcaaaatgttcaattttataaaaacatatcaaaatatctctattctttataataatcacaaccaaaaaaaa

SEQ ID NO: 318 - protein, 195 aa, Dictyostelium discoideum
MQSIKLVVVGDGAVGKTCLLISYTSNSFPTEYVPTVFDNYSANVMVDNKTVSLGLWDTAGQEDYDRLRPLSYPQTDVFLICFAIISQTSYTNVKSKWWPEVTHHCPNCTIILVGTKCDLREDKESLEKLREKHQQPLTFQQGEQMAKEIKAFCYMECSALTQKGLKQVFDEAIKAVIFPDRDKATNKKNSKCSIL

SEQ ID NO: 319 - DNA, 634 bp, Dictyostelium discoideum
  CDS (46)..(624)
gatcatatttaaattatacaaaaaacaattacatatatataaagaatgtcagcagcagaagttattaaattagtcgttattggtgatggtgctgtaggtaaaacttgtttattgattagttatgcaaacaatcgtttcccagaagattatattccaactgtattcgataattatgttgtaaatcttacagcaggtgatagaaacatagaactcggactttgggatactgcaggtcaagaagagtacgataaattaagaccattaagttatgcaaatgcaaatgtatttttaatttgcttctcaattaccaatccagtttcatttgaaaatgtttacacaaaatggtacccagaagttatgcatttttgcccagaagttccacaaattttagttggtactaaattagatacacgtgacgatagaggtgttttagataaacttcaacaaactggtcataaaccaattacaaccgaacaaggtaacgatttagccagaagaattaaagccattaaatatatggaatgttctgccaaaacctcacaaaatctcaaacaagtctttgatgaagccattaaatctgttttgtttatcaaaaaaaagaaatccaagtgtattgttatgtaacccgctctcc

SEQ ID NO: 320 - protein, 192 aa, Dictyostelium discoideum
MSAAEVIKLVVIGDGAVGKTCLLISYANNRFPEDYIPTVFDNYVVNLTAGDRNIELGLWDTAGQEEYDKLRPLSYANANVFLICFSITNPVSFENVYTKWYPEVMHFCPEVPQILVGTKLDTRDDRGVLDKLQQTGHKPITTEQGNDLARRIKAIKYMECSAKTSQNLKQVFDEAIKSVLFIKKKKSKCIVM

SEQ ID NO: 321 - DNA, 765 bp, Dictyostelium discoideum
  CDS (1)..(765)
atggctacaggtattaagaaaactgttaaagtagtagttgtaggtgatggtgctgttggtaaaacttcacttttaattttatatacaactaaagcattcccaaaagattatgtaccaacagtatttgataactttaattgtttagagatgtacgataataaaccagttaatttagtattgtgggataccgctggtcaagaagattatgataatttacgtccattgtcatatccacagactgatgtatttataatatgttattcagtagttaaaagagattcgttagataatataaagtataaatggttacctgaaattaatcaaactaatcagggtacaccaattattttagttggtacaaagactgatttaagggaggacaaaaaaacattatcacaattacaagaatcaaaacaagaaccagtttcaagagatgaaggtgtagcattagcaaaagagataggtgcagtacaatttttcgaatgttctgcattgacaggtaatggtgtaaatgatattttcgctgctgcaattaaagcagcttttaataaacctgctgtaacttcaccaacttcgaaatctagtggtaaatcttcaccttcatctacctcttcaaaaccttctaaaactactactacaactacaacctcttcttcttcttcttcaccacctgctgcttcaactgcaaaaccagcaggtgaaaagaaattaagttggggtttgttccgtaaaaaagataaagatgaaaagaaaccagcaaaataa

SEQ ID NO: 322 - protein, 254 aa, Dictyostelium discoideum
MATGIKKTVKVVVVGDGAVGKTSLLILYTTKAFPKDYVPTVFDNFNCLEMYDNKPVNLVLWDTAGQEDYDNLRPLSYPQTDVFIICYSVVKRDSLDNIKYKWLPEINQTNQGTPIILVGTKTDLREDKKTLSQLQESKQEPVSRDEGVALAKEIGAVQFFECSALTGNGVNDIFAAAIKAAFNKPAVTSPTSKSSGKSSPSSTSSKPSKTTTTTTTSSSSSSPPAASTAKPAGEKKLSWGLFRKKDKDEKKPAK

SEQ ID NO: 323 - DNA, 672 bp, Dictyostelium discoideum
  CDS (1)..(672)
atgtcagaagatcaaggttcaggagcaacaagagttaaattagtagttgtcggtgatggtgctgttggtaaaacatgtcttttaatttgttatgcacaaaatgattttccagtagattatgtaccaactgtttttgaaaattatacagcaaccagaaagagaggaaatgaagatattaaagtacatttatgggatactgcaggccaagaagaatatgatcgtttacgtccattatcatacccaggcgctgatgttgttctcctttgtttcagcacaatcagtcaatcatcatatgaagccattagagataaatgggcaccagaagttaatcactatatcccagatgtaccatcaattttagttggtactaaaatcgatttacgtgaacaacaacacccagatccaaactctggtaaattcgaaccaatcactgccgatatgggtatttcaatgcaaaaacaaattaaagccaagaaatatttagaagtctctgcaaagactcgtcaaggtttagaagaagttttcagtgctgccattgaaatcgttcttgaatcaagaggtatggataaaaagagtcaagatggttcttcaagtgcatctggtgttccatcaggtgataaaccaacaaaaggaaaagcaggtaaaaagaaatctggttgtattatactttaa

SEQ ID NO: 324 - protein, 223 aa, Dictyostelium discoideum
MSEDQGSGATRVKLVVVGDGAVGKTCLLICYAQNDFPVDYVPTVFENYTATRKRGNEDIKVHLWDTAGQEEYDRLRPLSYPGADVVLLCFSTISQSSYEAIRDKWAPEVNHYIPDVPSILVGTKIDLREQQHPDPNSGKFEPITADMGISMQKQIKAKKYLEVSAKTRQGLEEVFSAAIEIVLESRGMDKKSQDGSSSASGVPSGDKPTKGKAGKKKSGCIIL

SEQ ID NO: 325 - DNA, 579 bp, Homo sapiens
  CDS (1)..(579)
atgcaggccatcaagggtgtggtggtgggagacggagctgtaggtaaaacttgcctactgatcagttacacaaccaacgcatttcctggagaagatatccctactgcctttgacaattattctgccaatgttatggtagatggaaaactggtgaatctgggcttatggaatacagctggacaagaagattatgacagattacgccccctatcctatccgcaagcagatgtgttcttaatttgcttttcgcttgtgagtcctgcatcatttgaaaatgtccttgcaaagtggtatcctgaggtgcagcaccactgtcccaacactcccattatcctagtgggaactaaacttgatcttagggatgataaagacaggatccagaaactgaaggagaagaagctaactcccatcacctatccgcagggtctagccatggctaaggagatgggtgctgtaaaatacctggagtgcttggccctcacaaggcgaggcctcaagacagtgtttgacgaagcgatccgagctgtcctctgcccacctcccgtgaagaagaggaagagaaaatgcctgcagttgtag

SEQ ID NO: 326 - protein, 192 aa, Homo sapiens
MQAIKGVVVGDGAVGKTCLLISYTTNAFPGEDIPTAFDNYSANVMVDGKLVNLGLWNTAGQEDYDRLRPLSYPQADVFLICFSLVSPASFENVLAKWYPEVQHHCPNTPIILVGTKLDLRDDKDRIQKLKEKKLTPITYPQGLAMAKEMGAVKYLECLALTRRGLKTVFDEAIRAVLCPPPVKKRKRKCLQL

SEQ ID NO: 327 - DNA, 594 bp, Dictyostelium discoideum
  CDS (5)..(589)
cataatgcaagcaattaaatgtgtagttgttggtgatggtgcagttggtaaaacatgtcttttaatttcatatacaaccaatgcttttccaggagagtatatcccaacagtttttgataattacagcgcaaatgtaatggttgatggtaaaccaattaatctcggattatgggatacagcaggtcaagaagattatgatcgtttacgtcctttatcctatcctcaaactgatgttttcttaatttgtttttcaatcgtttcaccagcatcttttgagaatgtaaatggtaaatggcatccagaaatatgtcaccatgcaccaaatgttcgaatcattttagttggtactaaattagatatgagagaagatagagatactcaagatagattaaaagagaaaaaactttatccagtttcctatgaacaaggtctttcaaaaatgaaagaaattaatgctgtcaaatatcttgaatgttcagctctcacacaaaaaggtcttaaaactgtttttgatgaagcaattagatctgtaattaatccaactcttaagaaaaaaccaaaatcttcaaaaggttgtattataatgtaaaaaaa

SEQ ID NO: 328 - protein, 194 aa, Dictyostelium discoideum
MQAIKCVVVGDGAVGKTCLLISYTTNAFPGEYIPTVFDNYSANVMVDGKPINLGLWDTAGQEDYDRLRPLSYPQTDVFLICFSIVSPASFENVNGKWHPEICHHAPNVRIILVGTKLDMREDRDTQDRLKEKKLYPVSYEQGLSKMKEINAVKYLECSALTQKGLKTVFDEAIRSVINPTLKKKPKSSKGCIIM

SEQ ID NO: 329 - DNA, 591 bp, Dictyostelium discoideum
  CDS (8)..(589)
aaaaaaaatgcaagcaattaaatgtgtagttgtaggtgatggtgcggttggtaaaacatgtcttttaatttcttatacaactaacgcttttcctggagagtatatcccaacagttttcgataattactcagctaatgttatggttgatggtaaaccaattaatcttggcttgtgggatactgctggtcaagaagattatgatcgtttacgtccactttcatatcctcaaactgatgttttcttaatttgcttttcaattatttctccatcatcatatgaaaatgtttcaggtaaatggggaccagaagtatttcatcatgctccaaatgttccaatcattttggttggtacaaaaatggatatgagagaagataaggaaactcaagatagattaaaagaaaagaaactttatccagtttcctatgaacaaggtcttttaaaaatgaaagaaattaatgctttcaaatatcttgaatgctctgctctcactcaaaaaggtcttaaaactgttttcgacgaagctattagatctgtaattaatccaccagttaaaaaatcaaaaagtaaaagtggatgtaatatcttgtaaaa

SEQ ID NO: 330 - protein, 193 aa, Dictyostelium discoideum
MQAIKCVVVGDGAVGKTCLLISYTTNAFPGEYIPTVFDNYSANVMVDGKPINLGLWDTAGQEDYDRLRPLSYPQTDVFLICFSIISPSSYENVSGKWGPEVFHHAPNVPIILVGTKMDMREDKETQDRLKEKKLYPVSYEQGLLKMKEINAFKYLECSALTQKGLKTVFDEAIRSVINPPVKKSKSKSGCNIL

SEQ ID NO: 331 - DNA, 723 bp, Entamoeba histolytica
  CDS (22)..(621)
aaataaaaaaaaacatgacctatgagaccagtgaaacttgtcatcgtcggtgatggtgccgtcggtaaaacttgtatgttaatttcatatacaacaaatgctttcccaaatgaatatattccaacagtctttgaaaattataattcttcattggttgttgatgatgttaaaattaatcttggattatgggatactgctggacaagaagattatgatagattaagaccattatcatatccatcaactgatgtattccttgtttgtttctccgttattgctccagcttcatatgaaaatgttgaaggtaaatggaaaccagaaattgatcaacactgtccaaatgtaccaattattcttgttggaactaaaattgatattagagatgatccagaacaagttaaacgtttagctgaaaagaatattgtcccaattcaacctcctcaaggagatgaattagcaaagaaaattggtgctgttaaatatattgaatgttctgctttaacacaagccaatcttaaacttgtttttgaagaagctgttagagctgttcttgctaaagctgctaaagagccaactggaaagaaagaaaaaggaggtaagaaaggatgctcattattctaatttcactttttagttgataaattgaagaagttgttataaaagaaaatatatttgttttttgtaaaaaaatagaaaataaaagaagaaaaagattgatttaaa

SEQ ID NO: 332 - protein, 199 aa, Entamoeba histolytica
MRPVKLVIVGDGAVGKTCMLISYTTNAFPNEYIPTVFENYNSSLVVDDVKINLGLWDTAGQEDYDRLRPLSYPSTDVFLVCFSVIAPASYENVEGKWKPEIDQHCPNVPIILVGTKIDIRDDPEQVKRLAEKNIVPIQPPQGDELAKKIGAVKYIECSALTQANLKLVFEEAVRAVLAKAAKEPTGKKEKGGKKGCSLF

SEQ ID NO: 333 - DNA, 597 bp, Candida albicans
  CDS (1)..(597)
atggttaacggtccagctgaacttcgtagaaaattagtcattgtcggtgatggtgcttgtggtaagacttgtttattaattgttttttcaaaaggtactttcccagaagtttatgtcccaacagtttttgaaaattacgttgctgatgttgaagttgatggtagaaaagttgaattggcattatgggatactgctggtcaagaagattatgatagattaagaccattatcttatccagattctaatgttattttgatttgtttttcagttgattcaccagattctttagataacgttttagaaaaatggatttctgaagttttacatttctgtcaaggtgttccaatcattttagttggttgtaaatctgatttaagagatgatcctcatactattgaagccttgagacaacaacaacaacaaccagtctcaacttctgaaggccaacaagttgctcaaagaattggtgctgctgattacttggaatgttctgctaaaaccggtagaggtgttagagaagtgtttgaagctgctactagagcttctttaagagttaaagaaaagaaggaaaagaagaagaaatgtgttgtcttgtaa

SEQ ID NO: 334 - protein, 198 aa, Candida albicans
MVNGPAELRRKLVIVGDGACGKTCLLIVFSKGTFPEVYVPTVFENYVADVEVDGRKVELALWDTAGQEDYDRLRPLSYPDSNVILICFSVDSPDSLDNVLEKWISEVLHFCQGVPIILVGCKSDLRDDPHTIEALRQQQQQPVSTSEGQQVAQRIGAADYLECSAKTGRGVREVFEAATRASLRVKEKKEKKKKCVVL

SEQ ID NO: 335 - DNA, 1165 bp, Kluyveromyces lactis
  CDS (102)..(728)
aagtgtcataaaacagaattactcaagagttttcgaacagctttgattttataatacaataaaaaaaagtagtgatttgatttgttttaaccctttccataatgtctcaagctgttggtaatgttgccagcattagaagaaagctagttattgtcggtgatggtgcgtgtggtaagacttgtttattgattgttttcgccaagggtaagttccctcaggtttacgtgcccactgttttcgataattacgttgctgatgtcgaagttgacggtcgtcgcgtagaattggcgttgtgggatactgctggccaagaagattatgatagattgagaccactttcgtacccagattccaacgttgtgttaatctgttactcaattgatttgccagattccttagaaaacgtgatggaaaaatggatctctgaagttttacacttttgtcaaggtgttccaatcatcttggttggttgtaaagcagatttgagaaatgatcctcaagttgttgaagaactaagagctcaaggattacaacctgtgtctcaggctcaagcacaagaagtcgctgaccaaatcggtgctgttgactacatcgaatgttctgccaagaccggttacggtgtcagagaagtcttcgaggctgctacaagagcttctttggtcggtaaacaaggtaagagcaaacctaagactaagtctagcaaaaaaaagaagtgtgtcgtcttgtaaataaagacacgcacgccccaaacccactcttcacccccttatctccaacttcatttgaatttaccttgaaacagaggactgagctttgaggatattattattaggcgatgggaattgtttacaaccgttaattggcagaagtaaagatccaaaaaaaaagaagagggaagacgaacaaaccatattcatttgtttctaattgatcaatttttaatatacaaatgtcagcaattaatttccgttgaatttcctaattttttctcctcgttcttttctttgtttccatctggtttcaagtgaccatccctccctgacattttctcttctacctctcttctgttttgtgtgtttctacctataaattatttttatatacctacactcttttattttgtaagaaacttaaatattatcaccactatactgcactttctcat

SEQ ID NO: 336 - protein, 208 aa, Kluyveromyces lactis
MSQAVGNVASIRRKLVIVGDGACGKTCLLIVFAKGKFPQVYVPTVFDNYVADVEVDGRRVELALWDTAGQEDYDRLRPLSYPDSNVVLICYSIDLPDSLENVMEKWISEVLHFCQGVPIILVGCKADLRNDPQVVEELRAQGLQPVSQAQAQEVADQIGAVDYIECSAKTGYGVREVFEAATRASLVGKQGKSKPKTKSSKKKKCVVL

SEQ ID NO: 337 - DNA, 1181 bp, Schizophyllum commune
  CDS (139)..(759)
ctggtctctcgtcctttcttccaccacgcgcacgcgcacccacgtttcttctcccactcccggcgctgtcggccccgtcgccctcgcgtccttcctcttcctcttccgccagctcagtgacaggtacacactccccttatggcgctctgcggttcgtcgaaagggcgcggcaggggccgaccgatccagcgcaaggtcgtcgtatgcggcgacggcgcgtgcgggaagacgagtctgctgaacgtcttcacgagggggttcttcacgcaggtttatgaaccgacggtgttcgagaactacgtgcacgatctgtatatcgacgaccagctggtggagctgagtctctgggatacggcggggcaggaggagttcgaccggctacggagcctgtcgtatgcagaaacgcatgtgatcatgatatgcttcagcgtcgacaatccaacgtcgctcgagaatgtggagagcaagtggctcgacgagattttggagtactgtccgggcgtgaagttggtattggtcgactcaaaatgtgatctacgcgacgaccctgcagtactcgatcggctacaacgatacggtacacatacggatcaatatgaagagggcctcggggtcgcgcgaagaatacgagcttcacgatacttagagtgctcctccaaacacaaccggggcgttaacgaagtcttcttacgaggccgcgcgcgtgtcactgtccactcgatcaggcaggggagcgccgggtcgtgttgtgtcatgtagcgcacctcactctcgtcagtctagtcccccaagccgatcgacgctgcgctggcgctccccgtcgacctctcaaactgctctgccccactatgtcacaccaagcggcccatcgacccgtcctagaccacactacacaggtgttaggacgcaagagaactccagcgcggcccgccctcggtccccatgctcctgggcgtgtagtgcttcgtgcactcctgttcgtaggtgcgggggtactcctccccactcgtgcggtgctcaaggacgtgtagggggcagctcggtgcgctgtccgaataagatagatatatacccccccaccccgaaggtcacatacgcatggatatcttcacgctcaaatatgttacgctcccttaatctaactgcgtcttatatgggaattgaatgcgtttgatatgggc

SEQ ID NO: 338 - protein, 206 aa, Schizophyllum commune
MALCGSSKGRGRGRPIQRKVVVCGDGACGKTSLLNVFTRGFFTQVYEPTVFENYVHDLYIDDQLVELSLWDTAGQEEFDRLRSLSYAETHVIMICFSVDNPTSLENVESKWLDEILEYCPGVKLVLVDSKCDLRDDPAVLDRLQRYGTHTDQYEEGLGVARRIRASRYLECSSKHNRGVNEVFLRGRARVTVHSIRQGSAGSCCVM

SEQ ID NO: 339 - DNA, 618 bp, Schizosaccharomyces pombe
  CDS (1)..(618)
atgtcaagctgtttcggaagtaaaaagaagcctatttatcggaaaatcgtaattcttggtgatggtgctgctggtaaaaccagtttgttaaatgtatttactaagggttatttccctcaggtatacgagcctactatatttgaaaactacattcatgatatctttgtcgatggaaacagtatagaactgtctctatgggatacagctggtcaagaagagtatgatcaactgcgttcgttatcatattcagatacacatgttattatgatctgctttgccgtggattcacgagactcattagaaaatgtaatcacaaaatggcttccggaagtctctagtaattgccctggtgttaaattggttcttgttgctctaaaatgtgatttacgtggagctgatgaggagcaagttgatcacagtaaaattattgattacgaggaaggactggcagcggcaaaaaaaatcaacgctgtacgatatttagaatgcagcgctaaattaaatcgtggcgtaaatgaagctttcacggaagctgcacgcgttgcccttgccgcgcaaccaagaggtacaaaggatggtgctgatgaatcccatggtaccggatgtatcattgcttga

SEQ ID NO: 340 - protein, 205 aa, Schizosaccharomyces pombe
MSSCFGSKKKPIYRKIVILGDGAAGKTSLLNVFTKGYFPQVYEPTIFENYIHDIFVDGNSIELSLWDTAGQEEYDQLRSLSYSDTHVIMICFAVDSRDSLENVITKWLPEVSSNCPGVKLVLVALKCDLRGADEEQVDHSKIIDYEEGLAAAKKINAVRYLECSAKLNRGVNEAFTEAARVALAAQPRGTKDGADESHGTGCIIA

SEQ ID NO: 341 - DNA, 582 bp, Emericella nidulans
  CDS (1)..(582)
atggctgagatccgccgcaagcttgttatcgttggtgatggtgcctgcggtaagacctgtctgttgatcgtcttctcaaagggcactttccctgaggtctacgtccccaccgtctttgagaactacgttgccgatgttgaggttgatggcaagcacgtcgagctcgctctctgggatacggctggtcaagaagattacgaccgtctccgccctctctcctaccctgactcgcatgtcatcctgatttgcttcgctgtcgactcaccggattcccttgacaacgttcaagagaagtggatctctgaagtcctacacttctgccagggtctccccatcatcctcgtcggatgcaagaaggatcttcgccatgaccccaagacgatcgaggagctgaacaagacctctcagaagcctgtcacccccgaacagggtgaggaagtccgcaagaagattggcgcctacaagtacctcgagtgctctgctcgaaccaacgagggtgtccgtgaggtctttgaggctgccacgcgtgctgccctcttgaccaagacccacaagagcaagaagaagtgcagcatcctgtaa

SEQ ID NO: 342 - protein, 193 aa, Emericella nidulans
MAEIRRKLVIVGDGACGKTCLLIVFSKGTFPEVYVPTVFENYVADVEVDGKHVELALWDTAGQEDYDRLRPLSYPDSHVILICFAVDSPDSLDNVQEKWISEVLHFCQGLPIILVGCKKDLRHDPKTIEELNKTSQKPVTPEQGEEVRKKIGAYKYLECSARTNEGVREVFEAATRAALLTKTHKSKKKCSIL

SEQ ID NO: 343 - DNA, 1086 bp, Homo sapiens
  CDS (40)..(672)
cgcagccgcccgcccgcccgctcagcgcccggccccgggatgacggcggcccaggccgcgggtgaggaggcgccaccaggcgtgcggtccgtcaaggtggtcctggtgggcgacggcggctgcgggaagacgtcgctgctgatggtcttcgccgatggggccttccccgagagctacacccccacggtgtttgagcggtacatggtcaacctgcaagtgaaaggcaaacctgtgcacctccacatctgggacacagcagggcaagatgactatgaccgcctgcggcccctgttctaccctgacgccagcgtcctgctgctttgcttcgatgtcaccagcccgaacagctttgacaacatctttaaccggtggtacccagaagtgaatcatttctgcaagaaggtacccatcatcgtcgtgggctgcaagactgacctgcgcaaggacaaatcactggtgaacaagctccgaagaaacggattggagcctgtgacctaccacaggggccaggagatggcgaggtccgtgggcgcggtggcctacctcgagtgctcggctcggctccatgacaacgtccacgccgtcttccaggaggccgccgaggtggccctcagcagccgcggtcgcaacttctggcggcggattacccagggcttttgcgtggtgacctgagcggctcggggcgtcccagcgacgcgggaaggggcagggcgctgacctgctgctgagctggctgggctggacccggtccctaggctgtgaccgccgaactccactgcaacagacgggcgccaccaaagccaggccctgaggcctgggagtcctggactgagaaagggggttcctgggcccacctgctctgtgtagggctcgtcctgcggtgcccgagaatcactcgctaacccctatgcccggtcccggaccgacatcctggagccgcctgtgcagcctgatgccccctcgtggctgctcccagggctgcacctgccaggacctaatgttcttaggtccctctggccagaacccacacccggccccttcccacctgtcatactggtaactgtaacaagaaaaacgacatcactt

SEQ ID NO: 344 - protein, 210 aa, Homo sapiens
MTAAQAAGEEAPPGVRSVKVVLVGDGGCGKTSLLMVFADGAFPESYTPTVFERYMVNLQVKGKPVHLHIWDTAGQDDYDRLRPLFYPDASVLLLCFDVTSPNSFDNIFNRWYPEVNHFCKKVPIIVVGCKTDLRKDKSLVNKLRRNGLEPVTYHRGQEMARSVGAVAYLECSARLHDNVHAVFQEAAEVALSSRGRNFWRRITQGFCVVT

SEQ ID NO: 345 - DNA, 1166 bp, Mus musculus
  CDS (85)..(717)
gccgccgggccagccccgcgcccgccgcagccagcccgccgcgtaccgcctgctgctccgcgcaccgccgtccgccagccagggatgaacgcgtcccaggttgcgggagaagaggcgccgcagagcgggcactcggtcaaggtggtcctggtgggcgacgggggctgcgggaagacgtcactgatgatggtcttcgccaaaggggccttcccagagagctacagtcccacagtgtttgagcgctataatgccactctgcagatgaagggtaaacctgtgcacctccaaatctgggacacagccgggcaagatgactatgaccgcctccggcccttgttctatcctgatgccaatgtcttgctcctctgcttcgatgtgaccaatccaaacagctttgacaacgtctccaaccggtggtacccagaggtgacacatttctgcaagggagtgcccatcattgttgtgggctgcaagatagacctgcgtaaggacaaggtgctggtgaacaacctgcggaagaaaagactggagcccgtgacctaccacaggggccacgatatggcaaggtctgtgggagcggtggcctatcttgagtgttcagctcggctccatgacaacgtggaagcagtcttccaggaagcagcagaagtggctctcagcagtcgcagacataacttttggcggcggattactcagaattgttgcttggccacctgactggcttggaacccaccttgccaaccggtttactccgctgcagaaagacccagaagcagaacttgtactctgttgactgggatggacctaatccctaggctgagctggtagaaccacacatccatccacagatgggctccaatgaggcctggcccctggaaccgaatgaaacccggtaatgataggaaagaagtggtcccaagaacccttaagctctggaaaccaattaatagaacatcctgtgcccaaatcctgaacctgcgcctgaacggggtctgtgcggtctgtttggcgccaaccttgtggctaattctaattgaagttatatctacaggacctaagggttcccaagaaccaacttgcccgggctaataacctgcgccgtggctcaacaaccttaatttaatcccattgctaagtgtaacaactaaaatggcaagcacttgcta

SEQ ID NO: 346 - protein, 210 aa, Mus musculus
MNASQVAGEEAPQSGHSVKVVLVGDGGCGKTSLMMVFAKGAFPESYSPTVFERYNATLQMKGKPVHLQIWDTAGQDDYDRLRPLFYPDANVLLLCFDVTNPNSFDNVSNRWYPEVTHFCKGVPIIVVGCKIDLRKDKVLVNNLRKKRLEPVTYHRGHDMARSVGAVAYLECSARLHDNVEAVFQEAAEVALSSRRHNFWRRITQNCCLAT

SEQ ID NO: 347 - DNA, 735 bp, Sus scrofa
  CDS (1)..(735)
atgaaggagagaagagccagccagaaattatccagtaaatctatcatggatcctaatcagaacgtgaaatgcaagatagtagtggtgggagatagtcagtgtgggagaaccgcgctgctgcacgtcttcgccaaagactgcttccccgagaattacgtccctacagtgtttgagaattacacggccagtttcgaaatcgacacacaaagaatagaattgagcctgtgggacacttcgggttctccttactatgacaacgtccggcccctctcctacccagactcagacgccgtgctgatttgctttgacatcagtagaccagagactctggacagtgtcctgaaaaagtggaaaggtgaaatccaggagttttgtcccaacaccaaaatgctcttggtcggctgcaaatctgatcttcggacagatgtcagtacattagtagagctctcaaaccacaggcagacaccagtttcctacgaccagggggcaaatatggccaaacagattggagcagccacttacatcgaatgctcagctttacagtcagaaaatagcgtcagagacatttttcatgttgccaccttggcatgtgtaaataagacaaataaaaacgttaagcggaacaaatcgcagagggcaacaaagcggatttcacacatgcccagcagaccggaactctcggcagtggctacggacttacgaaaggacaaagccaagagctgcactgtgatgtga

SEQ ID NO: 348 - protein, 244 aa, Sus scrofa
MKERRASQKLSSKSIMDPNQNVKCKIVVVGDSQCGRTALLHVFAKDCFPENYVPTVFENYTASFEIDTQRIELSLWDTSGSPYYDNVRPLSYPDSDAVLICFDISRPETLDSVLKKWKGEIQEFCPNTKMLLVGCKSDLRTDVSTLVELSNHRQTPVSYDQGANMAKQIGAATYIECSALQSENSVRDIFHVATLACVNKTNKNVKRNKSQRATKRISHMPSRPELSAVATDLRKDKAKSCTVM

SEQ ID NO: 349 - DNA, 1017 bp, Homo sapiens
  CDS (30)..(665)
gccgccgccagtgctgcgggctccgggcaatggatgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcagggcctgagcgcctgcgaacagatccgagctgctctctacctggaatgttccgccaagtttcgggagaatgtggaggacgtcttccgggaggccgccaaggtggctctcagcgctctgaagaaggcgcaacggcagaagaagcgccggctctgcctgctgctctgacccagggcagacagacctcacgacagcactgacagggcccgggggcccaggtgccgattgcaccagggaggctgccccatcccgaccctccagctcatggtgtctggggcctgcggctagactcttggaacattctggaactctctcctttcctggctggggctctgaccacaaactcccctccaggctgcccctgggacatggtggtgatgtgggtgcaggagccagtgtctgttgtcgggactcgcaagtgccctcatcacagccacccccaccacgagtgtctccccagtgcagactcaagttatgcttgaaatgaaaaagtctatctggtagtgggtaaaaaaaaaaa

SEQ ID NO: 350 - protein, 211 aa, Homo sapiens
MDAPGALAQTAAPGPGRKELKIVIVGDGGCGKTSLLMVYSQGSFPEHYAPSVFEKYTASVTVGSKEVTLNLYDTAGQEDYDRLRPLSYQNTHLVLICYDVMNPTSYDNVLIKWFPEVTHFCRGIPMVLIGCKTDLRKDKEQLRKLRAAQLEPITYMQGLSACEQIRAALYLECSAKFRENVEDVFREAAKVALSALKKAQRQKKRRLCLLL

SEQ ID NO: 351 - DNA, 684 bp, Mus musculus
  CDS (1)..(684)
atggaggggcagagtggccgctgcaagatcgtagtggtgggggacgcggagtgcggcaagacagcgttgctgcaggtgttcgccaaggacgcctaccccgggagttatgtccccacggtgtttgagaactacactgccagcttcgagatcgacaagcgccgcattgagctcaacatgtgggatacttcaggttcctcttactatgacaatgtccggcctctggcctacccggattctgatgctgtgcttatctgctttgacattagccggccagaaacactggacagtgtcctcaagaagtggcaaggagagactcaggagttttgccccaatgccaaggtggtgctggttggctgtaagctggacatgcggactgacctggccacactgagggagctatccaagcagagactcatccctgtcacacatgagcagggtactgtgctggccaagcaagtgggagctgtgtcctacgttgaatgttcctcccgatcttctgagcgcagtgtccgggatgtcttccatgtggccacagtggcttctctcggccgtggccataggcagctacgtcgtactgactctcgccggggactgcagcgatccactcaactgtcgggacggccagaccggggaaatgagggcgagatgcataaggatcgagccaagagctgtaacctcatgtga

SEQ ID NO: 352 - protein, 227 aa, Mus musculus
MEGQSGRCKIVVVGDAECGKTALLQVFAKDAYPGSYVPTVFENYTASFEIDKRRIELNMWDTSGSSYYDNVRPLAYPDSDAVLICFDISRPETLDSVLKKWQGETQEFCPNAKVVLVGCKLDMRTDLATLRELSKQRLIPVTHEQGTVLAKQVGAVSYVECSSRSSERSVRDVFHVATVASLGRGHRQLRRTDSRRGLQRSTQLSGRPDRGNEGEMHKDRAKSCNLM

SEQ ID NO: 353 - DNA, 576 bp, Brachydanio rerio
  CDS (1)..(576)
atgcagacgattaagtgtgtggtggtgggagacggtgcagtaggcaagacatgccttcttatttcttatacgacaaatgcctttccagaggagtacattcccacagtgtttgacaactacagtgctcagatgagtgtagatgggcgcactgtcagcctcaacctctgggacacggcagggcaggaggagtatgaccgtctgcgcacgctttcctacccacaaactaatgttttcatcatttgcttttccatcggaagcccttcatcattagctaatgttcgccacaagtggcacccggaggtgtctcaccactgtcccaacgtgccaattcttctagttggcaccaagaaggatctgcgttcagatacagagacaattaagaagttgaaggagcaagggcttgcaccctctactcaacagcagggtggcaccctgtgcaagcagatcaatgctgtgaggtatctggagtgctcggcgctccgccaggaaggcgtgcgggatgtgtttgtagatgctgttcgtgctgtgctctaccccatgaccaaaaagaataccaagaagtgtgttctcttatag

SEQ ID NO: 354 - protein, 191 aa, Brachydanio rerio
MQTIKCVVVGDGAVGKTCLLISYTTNAFPEEYIPTVFDNYSAQMSVDGRTVSLNLWDTAGQEEYDRLRTLSYPQTNVFIICFSIGSPSSLANVRHKWHPEVSHHCPNVPILLVGTKKDLRSDTETIKKLKEQGLAPSTQQQGGTLCKQINAVRYLECSALRQEGVRDVFVDAVRAVLYPMTKKNTKKCVLL

SEQ ID NO: 355 - DNA, 576 bp, Xenopus laevis
  CDS (1)..(576)
atgcagagcattaagtgtgtggtggtgggcgacggagcagtgggaaagacctgtttactcatctgcttcacaaccaacgccttccctaaggaatacatccccacagtgtttgataactacagcgcccagacggcagttgacgggaggacagttagcttgaacctgtgggacactgctggccaggaagagtatgacagactgcgtacactttcttacccacagaccaacgtcttcatcatttgcttttccatcgccagcccaacctcctatgagaatgtaaagcacaagtggtaccctgaggtgggtcaccattgtcccaacgtgcccattctcttggtgggcaccaagaaggatcttaggaacaacgcagatgtcataaagaagctgaaagagcagaaccaaatgcccatcactaaccatcagggtggaaatctggccaagcagatccatgcagtaaagtatatggagtgctcggcgctgaatcaagatggcatcaaggaagtgtttgcggatgctgtgcgagctgttctcaacccgactcccatcaaggacaaaaagagctgcttcattttgtga

SEQ ID NO: 356 - protein, 191 aa, Xenopus laevis
MQSIKCVVVGDGAVGKTCLLICFTTNAFPKEYIPTVFDNYSAQTAVDGRTVSLNLWDTAGQEEYDRLRTLSYPQTNVFIICFSIASPTSYENVKHKWYPEVGHHCPNVPILLVGTKKDLRNNADVIKKLKEQNQMPITNHQGGNLAKQIHAVKYMECSALNQDGIKEVFADAVRAVLNPTPIKDKKSCFIL

SEQ ID NO: 357 - DNA, 591 bp, Xenopus tropicalis
  CDS (1)..(591)
atggccgcgatacgcaagaagctggtggtggtcggggacggagcttgcggcaaaacctgcctcctcatcgtcttcagcaaggacgagttccccgaggtgtacgttcccaccgtgttcgagaactacgtggccgatatcgaggtggacgtgaagcaggtggagctggccctgtgggacacggcggggcaggaggactacgaccggctgcggcctctctcctaccccgacacggacgtcatcctcatgtgcttctccgtggacagcccggactcgctggagaacatcccggagaagtgggtgcccgaggtgaagcacttctgccccagcgtccccatcatcctggtggccaacaagaaggacctgaggaacgacgagcacgtccgcaacgagctggcccgcatgaagcaggagccggtccgcaccgaggacggcagggccatggccgtgaggattaacgccttcgagtacctggagtgctcggccaagaccaaggaaggggtccgggaggtgttcgaaacggccactagggcggcgctgcagaagaaacacggccggagcggtgaatgtatgagctgctgtaagctcctctga

SEQ ID NO: 358 - protein, 196 aa, Xenopus tropicalis
MAAIRKKLVVVGDGACGKTCLLIVFSKDEFPEVYVPTVFENYVADIEVDVKQVELALWDTAGQEDYDRLRPLSYPDTDVILMCFSVDSPDSLENIPEKWVPEVKHFCPSVPIILVANKKDLRNDEHVRNELARMKQEPVRTEDGRAMAVRINAFEYLECSAKTKEGVREVFETATRAALQKKHGRSGECMSCCKLL

SEQ ID NO: 359 - DNA, 735 bp, Xenopus laevis
  CDS (1)..(735)
atgaaggaaagaagaacgagtcagaaactggccagcaaatcaatgatggatcccaaccagaatgtgaaatgtaaaattgtggtggtgggggacagccagtgtggcaaaactgccctgctccatgtctttgccaaggactccttcccagagaactatgtccccaccgtatttgagaattacacggccagttttgaaattgacacgcagaggatagaactgagtctctgggatacatctggttccccttattatgacaacgtccgacctcttagctatccagactctgacgccgttttgatatgtttcgatatcagtcgccccgagacgcttgacagtgttcttaaaaagtggaaaggtgaaattcaagaattctgccccaataccaaaatgctgctggttggctgcaaatccgacctccgtacagatctaaccacattagtagaactatctaaccacagacagacgccagtctcctatgatcagggggcaaacatggccaagcagataggagcagccacgtacatcgaatgctctgcgttacagtctgagaacagtgtcagagacattttccatgtagccaccctggcatgtgtgaataagactaacaaaaatcttaaaaggaataaaactcaaagagccacaaagagaatctcgcacatgccgagtcggccagaactaagtgctgtggccacagacttgaggaaggataaagcaaagagctgcagcatcatgtga

SEQ ID NO: 360 - protein, 244 aa, Xenopus laevis
MKERRTSQKLASKSMMDPNQNVKCKIVVVGDSQCGKTALLHVFAKDSFPENYVPTVFENYTASFEIDTQRIELSLWDTSGSPYYDNVRPLSYPDSDAVLICFDISRPETLDSVLKKWKGEIQEFCPNTKMLLVGCKSDLRTDLTTLVELSNHRQTPVSYDQGANMAKQIGAATYIECSALQSENSVRDIFHVATLACVNKTNKNLKRNKTQRATKRISHMPSRPELSAVATDLRKDKAKSCSIM

SEQ ID NO: 361 - DNA, 1035 bp, Pagrus major
  CDS (25)..(603)
cggcacgaggcgcagcggaacaggatgcaggctatcaaatgtgtggtcgtgggagatggagctgtgggaaaaacatgtcttctcatcagctacacaaccaatgccttccccggggagtacattcctactgtatttgacaactactcagctaatgtgatggtggacagcaagccagtcaacctgggcctctgggatacagctggacaggaagactacgacaggctccgcccactgtcctacccacagacggatgttttcctgatctgtttctccctggtgagcccagcgtcctatgagaacgtcagagctaagtggtacccagaggttcgccaccactgcccctccacacctatcatcctggtgggcaccaagctggatctgagggacgagaaggaaaccattgagaagctgaaggaaaaaaagctggcgccgatcacctacccccagggcctggctctggctaaggagatcgatgcagtgaagtacctggagtgctcagccttgacccagcgtggcctgaagaccgtgttcgacgaggccatccgggccgtgctctgccctcagcccaccaaggtcaagaagaagccgtgctcactgctgtaaatgattcttgcaagacgaagacgacgacgatgagaaagcgtttgcgactgatgaaaaggtgaaaagaagacgatgggaaagttctgttatgtttaatggtttgtgatagaagactgcgactagatttccactaggttagaaaaaaataatgcttgtgcggtgatgataaatggtaaatggtagcaaaccctttctgtacagcatactctgagactgattattcaagtgcattatagaccaggcagacatttcactgtaaaattgaacaaagtatatcactagatgtggaggctgacacactgtacattcatcctgtgggcttaaatggtcagatcaagagcagcaaagcacctgcacaacggactctgctgtcccttttggggctgacagtatgtacacaggtgtcttgtgcggcttcacataatgataata

SEQ ID NO: 362 - protein, 192 aa, Pagrus major
MQAIKCVVVGDGAVGKTCLLISYTTNAFPGEYIPTVFDNYSANVMVDSKPVNLGLWDTAGQEDYDRLRPLSYPQTDVFLICFSLVSPASYENVRAKWYPEVRHHCPSTPIILVGTKLDLRDEKETIEKLKEKKLAPITYPQGLALAKEIDAVKYLECSALTQRGLKTVFDEAIRAVLCPQPTKVKKKPCSLL

SEQ ID NO: 363 - DNA, 1090 bp, Schizophyllum commune
  CDS (145)..(735)
gctgctcgccttgttcttccattgtccatccccttgcccgtgctcccgcggtcgctgaacgtacccaagccctcgcctccccgtcgcgtcgtctgccttcttcccctcggtttccgatagtcgctccgttgcccagtccccagtatgcaggccatcaagtgtgttgtcgtaggagatggtgcggtcggaaagacctgcctgctaatctcgtataccacgaacgcgttcccgggagaatatatcccgaccgtgttcgataactactccgccaatgtcatggtcgacggcaagactatctccctcgggctttgggataccgctggtcaagaagattacgaccgtctccgcccgctctcctaccctcagacggatgtcttcttgatttgtttctcgctcgtcagcccgccaagtttcgagaacgtccggaccaagtggtaccctgaaatatcgcatcacgcaccgcagacgcccgtcgtgctcgtgggcaccaagctggatttgcgagaggaccctgcgacgatagagaaactgcgtgaccgccgcatgtcccccatccagtactcgcagggtgtcgcgatgatgaaggacatcggtgctgtgaagtacctagagtgttccgcgctgacgcaaaaggggctcaagaccgtgtttgacgaggcgatccgtgttgtcttgtacccgtccgcgcggtccgacaacaaacgcagcaagggccgctcatgcattgtcgcataagtggactccagcgccgctgtatgggtggacgaaccacaggaagtgttgtgcgcactgtatcatcacgcggcgcgcggcgctccctgcactatatcacgccatttatgtctttcttctagcactatctcctttttcgcgccagctgctgatatccgcacggtttcctgccaacacataccagtggaactcgaggatcctgaccattttgctactcgtcacgaccacccttgcctcacaccccctttgtgttgactctcaggttctgtaattcgacgacctgctcttcgaatttcgctcccctttgcccacatagcacatatagtatcaccgtgacgaactgtatcctccttgacga

SEQ ID NO: 364 - protein, 196 aa, Schizophyllum commune
MQAIKCVVVGDGAVGKTCLLISYTTNAFPGEYIPTVFDNYSANVMVDGKTISLGLWDTAGQEDYDRLRPLSYPQTDVFLICFSLVSPPSFENVRTKWYPEISHHAPQTPVVLVGTKLDLREDPATIEKLRDRRMSPIQYSQGVAMMKDIGAVKYLECSALTQKGLKTVFDEAIRVVLYPSARSDNKRSKGRSCIVA

SEQ ID NO: 365 - DNA, 576 bp, Paracoccidioides brasiliensis
  CDS (1)..(576)
atggctgagattcgtcgtaaacttgtcattgttggtgatggtgcctgtggtaaaacttgtctcttgattgtcttttccaagggtaccttccctgaggtctacgtcccaaccgtcttcgagaactatgtggccgacgttgaggtcgatggaaagcatgtcgagctcgcactttgggatacggctggccaggaagattacgatcgactcagacctctttcctaccctgattcacatgttattctgatctgtttcgctatcgattcccccgactctctcgacaacgtccaggagaagtggatttctgaagtccttcatttctgccagggtcatcccattatcctcgttggttgcaagaaagatcttcgtgacgaccccagaacgattgaggagctgcgcaagacgtctcagaagcccgtgaccaccgaacagggtgaggaggtccgcaagaagattggcgcttacaagtatctggaatgctccgcccgaacaaacgacggagttcgtgaggtgttcgagtcagctactcgagctgcactgctggcgaagaaggagaaaaagaaatgcaagatcttgtaa

SEQ ID NO: 366 - protein, 191 aa, Paracoccidioides brasiliensis
MAEIRRKLVIVGDGACGKTCLLIVFSKGTFPEVYVPTVFENYVADVEVDGKHVELALWDTAGQEDYDRLRPLSYPDSHVILICFAIDSPDSLDNVQEKWISEVLHFCQGHPIILVGCKKDLRDDPRTIEELRKTSQKPVTTEQGEEVRKKIGAYKYLECSARTNDGVREVFESATRAALLAKKEKKKCKIL

SEQ ID NO: 367 - DNA, 591 bp, Fucus distichus
  CDS (1)..(591)
atgcagaacataaagtgcgtcgtcgtgggtgacggtgcggttggtaaaacctgcctcctcatctcctacacgacgaacgcgtttcctggggaatacatcccaactgtcttcgacaactatagcgctaatgtaatggtcgacggaaagccgatcaacctgggcctttgggatactgcagggcaggaagattacgatcgactccggccactgagctacccgcaaacggacgtatttcttgtgtgcttcagcgtcgttgaccccaccagctttcacaacgtgaagctcaagtggatacccgagctgcaacaccatgctccgggcatcccatttatactggttggtacgaagctcgacctgagggatgatcaagacgcgatcaagcgtctagcagaacgtcggcagacgcccatcagcttcagcgaggcgcagggtctgtcgtctgaccttgaagcttaccgctaccttgagtgcagcgcgctgacgcaacacgggttaaaacaggtgtttgacggggctatccggtgtgttctagaacagaaccagagaaagatgaaaaagaaaaagggcaagaaaggctgcgtcatctcttga

SEQ ID NO: 368 - protein, 196 aa, Fucus distichus
MQNIKCVVVGDGAVGKTCLLISYTTNAFPGEYIPTVFDNYSANVMVDGKPINLGLWDTAGQEDYDRLRPLSYPQTDVFLVCFSVVDPTSFHNVKLKWIPELQHHAPGIPFILVGTKLDLRDDQDAIKRLAERRQTPISFSEAQGLSSDLEAYRYLECSALTQHGLKQVFDGAIRCVLEQNQRKMKKKKGKKGCVIS

SEQ ID NO: 369 - DNA, 636 bp, Homo sapiens
  CDS (1)..(636)
atgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagttggagaaacgtacggtaaggatataacctcccggggcaaagacaagccgattgccgatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaa

SEQ ID NO: 370 - protein, 211 aa, Homo sapiens
MQAIKCVVVGDGAVGKTCLLISYTTNAFPGEYIPTVFDNYSANVMVDGKPVNLGLWDTAGQEDYDRLRPLSYPQTVGETYGKDITSRGKDKPIADVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 371 - DNA, 576 bp, Pneumocystis carinii
  CDS (1)..(576)
atgcaaactattaaatgtgtcgttgttggggatggcgcggttggtaaaacgtgtcttttaatatcctatacgacaaacaaatttccttcagaatatgttcctactgtatttgataattatgcggttaccgtaatgattggagaagaaccttatactttaggactttttgatacagcaggtcaagaagattatgacagattgcgtcccttatcatatccacaaacggatgtttttcttatttgcttttctgttactagtccagcaagttttgaaaatgtaagagaaaagtggcatccagaggttcgtcatcattgtccaggaacaccctgtcttattgttggtacacaaatcgatttacgagatgatcctatgattgtagagaaactcagtcgacaaagacaaacccccattacaaaagaattaggtgaaaaactttcaaaagaattgggtgctgtaaaatatgttgagtgctcagctttgactcaaaaaggattaaaaaacgtttttgatgaagctatagtttgcgcacttgaaccacccgttacgaagaagaaaactaaatgtcttattttataa

SEQ ID NO: 372 - protein, 191 aa, Pneumocystis carinii
MQTIKCVVVGDGAVGKTCLLISYTTNKFPSEYVPTVFDNYAVTVMIGEEPYTLGLFDTAGQEDYDRLRPLSYPQTDVFLICFSVTSPASFENVREKWHPEVRHHCPGTPCLIVGTQIDLRDDPMIVEKLSRQRQTPITKELGEKLSKELGAVKYVECSALTQKGLKNVFDEAIVCALEPPVTKKKTKCLIL

SEQ ID NO: 373 - DNA, 630 bp, Ashbya gossypii
  CDS (1)..(630)
atggcgtaccagacaggcggcaacatacgcaagaagttggttattgtcggcgacggggcgtgtgggaagacgtgtctgctcgttgtgttctccaaagggcagttcccggagatccatgtgcccacggtgttcgagaactacgtggcagatgtggacatcgacgggcgacgcgtagagctggcactgtgggatacagcgggccaggaggactacgaccggctgcggccattgtcgtacccggattccaatgtggtgcttatctgtttctctgtggacctacctgactcgctggacaatgtgcaggagaagtgggtcagcgaagttctgcacttctgccagggcgtgccaattttactggtaggctgcaaggtggatctgagaaacgaccctcaggtgctccagcagctgcaggccgagggccagcgccccgtgaccgccgcagagggctcagccgtcgccggtaagataggcgccgtcgcctacctcgagtgctctgcgcgcacaggccagggtgtgaaggaggttttcgacactgcgacccgcgccgcactctctggcaagcccgccgcgtctgcaggcaagaagaaggtccacggtgacaagaagaagaagaaatgtctggtcctgtga

SEQ ID NO: 374 - protein, 209 aa, Ashbya gossypii
MAYQTGGNIRKKLVIVGDGACGKTCLLVVFSKGQFPEIHVPTVFENYVADVDIDGRRVELALWDTAGQEDYDRLRPLSYPDSNVVLICFSVDLPDSLDNVQEKWVSEVLHFCQGVPILLVGCKVDLRNDPQVLQQLQAEGQRPVTAAEGSAVAGKIGAVAYLECSARTGQGVKEVFDTATRAALSGKPAASAGKKKVHGDKKKKKCLVL

SEQ ID NO: 375 - DNA, 564 bp, Ashbya gossypii
  CDS (1)..(564)
atgacggtcaacgttgtgagacggaagttggtaatcataggggatggggcatgcggcaagacgtcgttactacatgtgttcacgctggggaagttccctgaggaatatctgcccacggttttcgagaactacgttacggattgccgtgtagacggcataaaagtgcagttggcgctatgggatactgctggtcaggaagaatacgagcgtctgcgccccatgtcctactcgaaggcggacatcatattaatcgggtttgccatagacgacccggggtcgttgtccaatgcgcgggagaagtggacggtcgaggcgctgcgctactgtcccaacgccccgatcatcctcgtggggctcaaaaaggaccttcgccgccccgggacgcagtgcgcgatggtagcgccttcgcaggcacaagaggtggtgcgcgccatcggcgcaaagaaatacatggagtgcagcgcacttacgggggagggcgtggacgatgtgttcgagctggccacgagaacaagtcttctggtgaacaaggagccgggtcaaggctgttgcattatctcatga

SEQ ID NO: 376 - protein, 187 aa, Ashbya gossypii
MTVNVVRRKLVIIGDGACGKTSLLHVFTLGKFPEEYLPTVFENYVTDCRVDGIKVQLALWDTAGQEEYERLRPMSYSKADIILIGFAIDDPGSLSNAREKWTVEALRYCPNAPIILVGLKKDLRRPGTQCAMVAPSQAQEVVRAIGAKKYMECSALTGEGVDDVFELATRTSLLVNKEPGQGCCIIS

SEQ ID NO: 377 - DNA, 1043 bp, Tigriopus japonicus
  CDS (264)..(842)
aggaggagacgccttgtttgaaatccatccaacaacctgggactctctgctccagcagcaagcatcaccacccccatcaccatcatcttcatcctgatcaacacccttgagatccagatccccatccatcgatccacccatcctgaggattgactcacacacctcgaagattgtgggctgtgaaaaaccagtgtgggatcggcccttgcgtgcgtgaggtgggtggttgttgaaacccgactggcctgaccattgtcgtctcgatggcggctattcgcaagaaattagtgattgtgggcgatggcgcctgcggcaagacctgcctcttgatcgtgttctccaaggatcaattccccgaggtgtatgtgcccacagtgttcgaaaactacgtggctgacatcgaagtggacggcaagcaagtggaactggccttgtgggatacggccggtcaggaggactacgatcgactccgacccctgtcctatccggatacggatgtgatcctgatgtgtttctcgatcgactcgcccgattcgctcgagaacatccctgagaagtggacgcccgaagtcaaacacttctgccctaatgtgcccattatcctcgtgggaaacaaaaaagacttgcgcaatgatcccaataccatcaaggagttgggcaagatgaaacaagaaccggtcaagccggaagagggtcgcacaatggccgaaaagatcaacgccttcgcctacctcgagtgttcggccaagagcaaggaaggcgtcagagaagtctttgagacagccacccgagcggcattacaggtcaagaagaaaaagaagaagccttgcgttctcttttaatgtcggaaaccaaaccatttttcctattcttattacctatcttcatcatcaacatcaacatccttcaaccacaaatacaactacaactattactatacttctactactatggacgcgatcttaatttagtcgcaattatcaattggggaaatttacggaataaaacagaccctgagaacaaaaaaaaaaaaaaaaaaaaaa

SEQ ID NO: 378 - protein, 192 aa, Tigriopus japonicus
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNKKDLRNDPNTIKELGKMKQEPVKPEEGRTMAEKINAFAYLECSAKSKEGVREVFETATRAALQVKKKKKKPCVLF

SEQ ID NO: 379 - DNA, 1014 bp, Rhopalosiphum padi
  CDS (197)..(772)
tcaattgcgttctgccatttttttctaccgacgtcgatccgcgcgtgttgatctgccgggtacactccgtacacaggttggagatcgctgcaggcagcgttcgattgcgacaacgacgaccagcgagaacacttctctagtgctctgtgctgcttattcaccagtgtacacgtaggagtgttcccatagcggcaacatgcagaccatcaagtgcgttgttgttggtgatggagctgtcggtaagacttgtctgctcatatcgtacacaacaaacaaatttccttcagaatatgtaccgactgttttcgacaattatgcagtgacagttatgattggtggggaaccatacacattaggtttatttgatacagcaggtcaggaagattatgatcgcctcagacctttgagttatccacaaactgatgtgtttcttgtttgtttctctgtggttttaccatcttcatttgaaaatgtcaaagaaaaatgggttccggagataacgcatcactgtcaaaaaacaccattcctgttggttggcacacaaatagaccttagagaagatgccacaactgtggagaaactagccaaaaataaacaaaaatcaatatcatttgaacaaggagagaagctagctaaagaacttaaagctgtgaaatatgtcgaatgctcagcacttacacaaaaaggactaaaaaatgtatttgatgaagctattcttgcagctttagagcctcctgaaccagttaagaagaggaagtgtgttatattgtaaggctgcggataaataaacaggtgcgacaattatgtcataaaaatatttaagataaaacaatttaaatcatgatttagcatggatacaataatgaaataataattattttgtttttactaatctataaatatatatatataaataatttattttatattttacaagaaaatatgtgcattcattgaataataaataaataggttttttatacgccaaaaaaaaaaaaaaaaaaaaaaaaaaaa

SEQ ID NO: 380 - protein, 191 aa, Rhopalosiphum padi
MQTIKCVVVGDGAVGKTCLLISYTTNKFPSEYVPTVFDNYAVTVMIGGEPYTLGLFDTAGQEDYDRLRPLSYPQTDVFLVCFSVVLPSSFENVKEKWVPEITHHCQKTPFLLVGTQIDLREDATTVEKLAKNKQKSISFEQGEKLAKELKAVKYVECSALTQKGLKNVFDEAILAALEPPEPVKKRKCVIL

SEQ ID NO: 381 - DNA, 679 bp, Hordeum vulgare var
  CDS (14)..(655)
cgcgcggcgagccatggcgtccagcgcctcccggttcatcaagtgcgtcacggtgggcgacggcgccgtcggcaagacctgcatgctcatctgctacaccagcaacaagttccccaccgactacatacccacggtgttcgacaatttcagcgcgaacgtggtggcggacggcaccacggtgaatttgggcctttgggacaccgccgggcaggaggattacaaccggctgaggcctctaagctaccgcggcgccgacgttttcgtgcttgccttctcccttgtgagccgagctagctatgagaatatcatgaagaagtggataccggagcttcagcattacgcgcccggcgtacctgttgtgctggtaggcacaaaactggatcttcgtgaagataagcactatttgctggaccaccctgggatgatacccgttaccacagcacagggggaggaacttcgtaagcaagttggtgctttatattacatagagtgcagctcaaagacacaacagaatgtcaaagctgtgtttgatgctgctatcaaggtagtaatccagcccccaactaaacaaagagaaaagaagaaaaagaaacagcgtcggggatgttctatgatgaacttcagcggaaggaaaatgctatgcttcaaatcctgaatgatgaaagagaaggttccttgc

SEQ ID NO: 382 - protein, 213 aa, Hordeum vulgare var
MASSASRFIKCVTVGDGAVGKTCMLICYTSNKFPTDYIPTVFDNFSANVVADGTTVNLGLWDTAGQEDYNRLRPLSYRGADVFVLAFSLVSRASYENIMKKWIPELQHYAPGVPVVLVGTKLDLREDKHYLLDHPGMIPVTTAQGEELRKQVGALYYIECSSKTQQNVKAVFDAAIKVVIQPPTKQREKKKKKQRRGCSMMNFSGRKMLCFKS

SEQ ID NO: 383 - DNA, 762 bp, Hordeum vulgare var
  CDS (33)..(689)
ggatccgctggagaggagaggagaggagagacatgagcggcggagcgggggcggcgacggcggtgagcaggttcatcaagtgcgtggccgtgggcgacggcgccgtgggcaagacctgcatgctcatctgctacacctgcaacaagttccccaccgactacatccccaccgtgttcgacaacttcagcgccaatgtctccgtggacgggagcatcgtcaacctcggcctctgggacaccgcaggtcaggaggattacagcaggctgaggcctctgagctacaggggagccgatgtcttcatcctctccttctccctcaccagcagagcaagctatgagaatgtgcacaagaagtggatgccggagcttcgccggtacgcccccggcattcctgtactgcttgttggaaccaagttggatctccgggaggatagagcttatcttgctgatcatgcagctgattccatcataacaactgagcagggtgaggatcttaggagacaaataggtgctgtggcatacatagaatgcagctccaagacacaaaggaacattaaggctgttttcgacaccgcaatcaaggcggttcttcaacctcaaaggcacaaggaggtagccagaaaggaaactcggacacgctctagtcggtcagtaaggcagtacttctgtgggagttcttgtttcgcgtagccgagaagaacattctggagtctttcctcgacacgatgctcagatggcccgtggttgttctccaaatggggta

SEQ ID NO: 384 - protein, 218 aa, Hordeum vulgare var
MSGGAGAATAVSRFIKCVAVGDGAVGKTCMLICYTCNKFPTDYIPTVFDNFSANVSVDGSIVNLGLWDTAGQEDYSRLRPLSYRGADVFILSFSLTSRASYENVHKKWMPELRRYAPGIPVLLVGTKLDLREDRAYLADHAADSIITTEQGEDLRRQIGAVAYIECSSKTQRNIKAVFDTAIKAVLQPQRHKEVARKETRTRSSRSVRQYFCGSSCFA

SEQ ID NO: 385 - DNA, 721 bp, Hordeum vulgare
  CDS (38)..(676)
gtggaggcgcggcgagagcggcggaggcggaggagagatgagcgtgaccaagttcatcaagtgcgtcacggtgggggacggcgccgtcggcaagacctgcatgctcatctgctacaccagcaacaggttccccagtgattacatccccacggtgttcgacaacttcagcgccaacgtctccgtcgacggcaacatcgtcaacctcggcctatgggacaccgccgggcaagaagactacagccggctgaggccgctgagctacagaggcgccgacgtgttcgtgctcgccttctccctcatcagcagcgccagctacgagaatgttcttaagaagtggatgccagagctccgccggttcgcgccgaatgtccccattgttcttgttgggaccaagctagatctgcgtgaccacagagcctacctcgccgaccaccccggtgcttcagcaatcacaactgcacagggtgaagaacttaggaagcagatcggcgccgcggcttacatcgagtgcagctccaagacacagcagaacgtcaaggctgtgtttgacaccgccataaaggtggtcctccagccgccgaggagaagggaggtgatgtccgccaggaagaaaaccaggcgaagctctggatgctccatcaagcacttgatctgcgggagtacgtgcgctgcttgaattagcaccatggaggcctggactgactatggagatgaagcatgg

SEQ ID NO: 386 - protein, 212 aa, Hordeum vulgare
MSVTKFIKCVTVGDGAVGKTCMLICYTSNRFPSDYIPTVFDNFSANVSVDGNIVNLGLWDTAGQEDYSRLRPLSYRGADVFVLAFSLISSASYENVLKKWMPELRRFAPNVPIVLVGTKLDLRDHRAYLADHPGASAITTAQGEELRKQIGAAAYIECSSKTQQNVKAVFDTAIKVVLQPPRRREVMSARKKTRRSSGCSIKHLICGSTCAA

SEQ ID NO: 387 - DNA, 699 bp, Hordeum vulgare
  CDS (67)..(660)
  MISC_FEATURE (55)..(55): n is a, t, g, or c
ggatcccgattccatcaggaaagcatatagactagcccagtaaatagaaataagnaaagatcggcgatgagcgcatctcggttcatcaagtgcgtgacggtgggggacggcgccgtgggaaagacatgcctcctcatctcatacacatccaacaccttccccacagactatgtcccaacagttttcgacaacttcagcgctaacgtcgtggttgacggcagcaccgtcaacctcggattatgggatactgcaggacaagaagactataatcgactacgcccactaagctaccgtggtgccgatgtcttcctgctcgccttttctctcatcagcaaagcaagctacgagaatgtcactaagaagtggattccagagttacggcactatgctcctggcgtgcccataattcttgttggaacaaagcttgatctgcgggatgacaagcagttttttgtggatcaccctggggcggttcctatttccactgctcagggtgaagagctgaagaaggtgattggcgcgactgcctacatcgagtgcagctcaaaaacacagcagaacatcaaggcggtgtttgatgcggcgatcaaggtggtcctccagcctccgaagcagaagcggaagaagaggaagtcacagaaaggatgcagcatcttgtaaagctaaaatcccttttgttttgcagtgtctcgcgtcgac

SEQ ID NO: 388 - protein, 197 aa, Hordeum vulgare
MSASRFIKCVTVGDGAVGKTCLLISYTSNTFPTDYVPTVFDNFSANVVVDGSTVNLGLWDTAGQEDYNRLRPLSYRGADVFLLAFSLISKASYENVTKKWIPELRHYAPGVPIILVGTKLDLRDDKQFFVDHPGAVPISTAQGEELKKVIGATAYIECSSKTQQNIKAVFDAAIKVVLQPPKQKRKKRKSQKGCSIL

SEQ ID NO: 389 - DNA, 677 bp, Hordeum vulgare
  CDS (27)..(668)
ggatccttctcgtccatttagccggcatggcgtccagcgcctcccggttcatcaagtgcgtcaccgtcggggacggcgccgtcggcaagacctgcatgctcatctgctacaccagcaacaagttccccaccgactacgtgcccaccgtgttcgacaatttcagcgcgaacgtggtggtggacggcaccaccgtgaacctgggcctctgggacactgcagggcaggaggactacaacagattgagaccgctgagctaccggggagccgacgtcttcgtgctctccttctcgctcgtcagccgagccagctacgagaatgtcatgaagaagtggctaccggagcttcagcaccatgcacccggcgtgccaacagtgctggttggtacaaagctagatctacgtgaagacaagcaatacttacttgaccaccccggcgtggtgcctgttactacagctcagggggaggaactccgcaagcacatcggtgcaacttgttatgtcgaatgcagctcaaagacacagcagaatgtcaaagctgtgtttgatgctgccatcaaggtagtgatcaaacctccaacaaagcagagggaaaggaggaagaagaaagcacggcaaggatgtgcatcattgggtaccctgtcaagaaggaagctggcatgcttcaagtgatcagtcgac

SEQ ID NO: 390 - protein, 213 aa, Hordeum vulgare
MASSASRFIKCVTVGDGAVGKTCMLICYTSNKFPTDYVPTVFDNFSANVVVDGTTVNLGLWDTAGQEDYNRLRPLSYRGADVFVLSFSLVSRASYENVMKKWLPELQHHAPGVPTVLVGTKLDLREDKQYLLDHPGVVPVTTAQGEELRKHIGATCYVECSSKTQQNVKAVFDAAIKVVIKPPTKQRERRKKKARQGCASLGTLSRRKLACFK

SEQ ID NO: 391 - DNA, 565 bp, Nicotiana tabacum
  CDS (71)..(565)
ctttttccaatttcaactccataaaactaagaagctagtgttcttctttcttatctttctaattgatgagatgaatactagtagtagtgccagtaatagtgcttctactgcaacaggaacaaagttcatcaaatgtgtgacagttggagatggtgctgttggcaagacttgccttctcatctcctacactagctgccttctcatctcctacactagcaacacttttccaactgattatgtgccaactgtttttgacaatttcagtgctaatgtcaatgttgatgggaagattgtgaatttgggtctttgggatactgctggtcaagaggattataacaggcttaggcctcttagttatcgaggagctgacgtcttcttgcttgcattctctctcataagtaggcctagctttgaaaatatatcaaaaaagtgggttcctgagctaagacattatgccccatcagtgcctattgttcttgtggggactaaattggatttaagagaggacaagcagtttagaagggactaccctggtgcatctacaatttcaacagaacagggctag

SEQ ID NO: 392 - protein, 164 aa, Nicotiana tabacum
MNTSSSASNSASTATGTKFIKCVTVGDGAVGKTCLLISYTSCLLISYTSNTFPTDYVPTVFDNFSANVNVDGKIVNLGLWDTAGQEDYNRLRPLSYRGADVFLLAFSLISRPSFENISKKWVPELRHYAPSVPIVLVGTKLDLREDKQFRRDYPGASTISTEQG

SEQ ID NO: 393 - DNA, 1057 bp, Nicotiana tabacum
  CDS (176)..(808)
ggcacgagaagctattaattccaagctatctccacaccctctccccaaacaagaaaattattaaatgtaaaacgtactactagacccccagttacatacataaacacacatcatctgcagaattttggtatgcaattttacgtactttcttgaggtatttttttttttatgttcaatggcctcaagtgcttcaagattcatcaaatgtgtcacggttggtgatggtgccgttggaaagacttgtatgcttatttgctataccagtaacaagttccccactgattatgttcccacagtgtttgacaacttcagtgccaatgtggttgtcgaagggaccacagtaaatttaggtctttgggatactgcaggccaagaagattataacagattaaggccactgagctaccgaggagcagatgtttttgtcctagcgttctccttggttagtcgcgcaagctacgagaacatacttaaaaagtggattcctgaacttcagcattatgctcctggaataccggtggtattagctggcaccaaacttgatcttcgtgaggataagcacttcttggctgatcatcctggattagttcctgtcaccaccgcgcagggagaggagctacggaaacaaattggtgctgcctattacatcgaatgtagctctaaaacacaacagaatgtgaaagctgtctttgatgctgcaatcaaggtcgtcatcaagccaccgcagaagcaaaaggagaagaagaaacaacgtcgaggatgtctcatgaatgtgatgtgcggaaggaagctcgtttgtttgaagtgacatttcaatgtacatatttcccatctgttcggcctctaacatgatttatatccatggctttagcgtgctgcctataaaacttacatttctatcagaacttttgtgacgagcataatgtatttgtttttccataacccaacttactgctggacggccttgatttgtctgtaaaatacgttacttgctaggtttatatttcaagtacatgtattaattctattaaaccaacaaaaaaaaaaaaaaaaaaaa

SEQ ID NO: 394 - protein, 210 aa, Nicotiana tabacum
MASSASRFIKCVTVGDGAVGKTCMLICYTSNKFPTDYVPTVFDNFSANVVVEGTTVNLGLWDTAGQEDYNRLRPLSYRGADVFVLAFSLVSRASYENILKKWIPELQHYAPGIPVVLAGTKLDLREDKHFLADHPGLVPVTTAQGEELRKQIGAAYYIECSSKTQQNVKAVFDAAIKVVIKPPQKQKEKKKQRRGCLMNVMCGRKLVCLK

SEQ ID NO: 395 - DNA, 24 bp, unknown
  MISC_FEATURE (1)..(24): Primer
atgtctgaaaaggccgttagaagg

SEQ ID NO: 396 - DNA, 26 bp, unknown
  MISC_FEATURE (1)..(26): Primer
ttataaaattatgcaacagttagccc

SEQ ID NO: 397 - protein, 20 aa, unknown
  MISC_FEATURE (2)..(2): Xaa is any amino acid
  MISC_FEATURE (4)..(4): Xaa is Val, Thr, Ile or Leu
  MISC_FEATURE (5)..(5): Xaa is Val, Ile or Leu
  MISC_FEATURE (9)..(9): Xaa is Ala or Gly
  MISC_FEATURE (10)..(10): Xaa is any amino acid
  MISC_FEATURE (14)..(14): Xaa is Cys, Ser or Ala
  MISC_FEATURE (15)..(16): Xaa is Leu or Met
  MISC_FEATURE (17)..(18): Xaa is any amino acid
  MISC_FEATURE (19)..(19): Xaa is Tyr or Phe
  MISC_FEATURE (20)..(20): Xaa is Thr, Ser or Ala
  MISC_FEATURE (20)..(20): consensus
KXVXXGDGXXGKTXXXXXXX

SEQ ID NO: 398 - protein, 13 aa, unknown
  MISC_FEATURE (1)..(1): Xaa is Phe or Tyr
  MISC_FEATURE (3)..(4): Xaa is any amino acid
  MISC_FEATURE (6)..(6): Xaa is Val, Ile or Glu
  MISC_FEATURE (9)..(9): Xaa is Val or Ile
  MISC_FEATURE (11)..(11): Xaa is Asp or Glu
  MISC_FEATURE (12)..(12): Xaa is any amino acid
  MISC_FEATURE (13)..(13): Xaa is Tyr or Phe
  MISC_FEATURE (13)..(13): consensus
XPXXYXPTXFXXX

SEQ ID NO: 399 - protein, 22 aa, unknown
  MISC_FEATURE (1)..(1): Xaa is Val, Ile or Tyr
  MISC_FEATURE (2)..(2): Xaa is any amino acid
  MISC_FEATURE (3)..(3): Xaa is Leu, Val or Ile
  MISC_FEATURE (4)..(4): Xaa is any amino acid
  MISC_FEATURE (5)..(5): Xaa is Leu, Ile or Met
  MISC_FEATURE (6)..(6): Xaa is Trp or Phe
  MISC_FEATURE (9)..(9): Xaa is Ala or Ser
  MISC_FEATURE (12)..(13): Xaa is Glu or Asp
  MISC_FEATURE (14)..(14): Xaa is Tyr or Phe
  MISC_FEATURE (15)..(15): Xaa is any amino acid
  MISC_FEATURE (16)..(16): Xaa is Arg, Lys or Asn
  MISC_FEATURE (17)..(17): Xaa is Leu, Ile or Val
  MISC_FEATURE (19)..(19): Xaa is Pro, Ser or Thr
  MISC_FEATURE (20)..(20): Xaa 20 is Leu or Met
  MISC_FEATURE (21)..(21): Xaa is Ser, Ala or Phe
  MISC_FEATURE (1)..(22): consensus
XXXXXXDTXGQXXXXXXRXXXY

SEQ ID NO: 400 - protein, 148 aa, unknown
  MISC_FEATURE (1)..(148): Xaa in all postions is any amino acid
  MISC_FEATURE (1)..(148): consensus
KXVXVGDGAXGKTCLLIXXXXXXXXXXXXXXFPXXYXPTVFXNXXXXXXXXXXXXXXXLXLWDTAGQEDYXRLRPLSYXXXXXXXXXXXXXXXXXXXXXXDVXXXXFSXXXXXSXXNXXXKWXPEXXXXXXPXXPXXLVGXKXDLRXD

SEQ ID NO: 401 - protein, 216 aa, Brassica napus
MASTASKFIKCVTVGDGAVGKTCMLICYTSNKFPTDYIPTVFDNFSANVVVEGTTVNLGLWDTAGQEDYNRLRPLSYRGADVFVLSFSLVSRASYENVYKKWIPELQHFAPGVPLVLVGTKLDLREDNKHYLADHPGLSPVTTAQGEELRKLIGATYYIECSSKTQQNVKAVFDSAIKEVIKPVVKQKEKTQKTKKQKSNHGCLSNVLCGRIVTRH

We claim:

1. A process for the production of fine chemical comprising increasing or generating expression of at least one nucleic acid molecule in an organism or a part thereof, wherein the at least one nucleic acid molecule is selected from the group consisting of:

a) a nucleic acid molecule encoding the polypeptide as depicted in SEQ ID NO: 2;

b) a nucleic acid molecule comprising the nucleotide sequence as depicted in SEQ ID NO: 1; and c) a nucleic acid molecule which encodes a polypeptide having at least 95% sequence identity with the amino acid sequence of the polypeptide encoded by the nucleic acid molecule of (a) to (b) and conferring an increase in the amount of fine chemical in an organism or a part thereof;

by introducing the at least one nucleic acid molecule into an organism or a part thereof, growing the organism or the part thereof under conditions which permit production of at least one fine chemical in said organism or said part thereof, and recovering the at least one fine chemical produced by the organism or the part thereof, wherein the at least one fine chemical is selected from the group consisting of amino acids, carbohydrates, vitamins, organic acids, fatty acids, and carotenoids, and wherein the organism is selected from the group consisting of bacteria, algae, and plants.

2. The process of claim 1 further comprising the following steps:
   a) selecting an organism or a part thereof expressing the polypeptide encoded by the at least one nucleic acid molecule characterized in claim 1;
   b) mutagenizing the selected organism or the part thereof;
   c) comparing the activity or the expression level of said polypeptide in mutated organism or part thereof obtained in step b) with the activity or the expression of said polypeptide of the selected organism or the part thereof;
   d) selecting a mutated organism or a part thereof, which comprises an increased activity or expression level of said polypeptide compared to the selected organism or the part thereof;
   e) optionally, growing and cultivating the mutated organism or the part thereof; and
   f) recovering, and optionally isolating, the free or bound fine chemical produced by the mutated organism or the part thereof.

3. The process of claim 1, wherein the activity of said polypeptide or the expression of said at least one nucleic acid molecule is increased or generated transiently or stably.

4. The process of claim 1, wherein the at least one nucleic acid molecule encodes a polypeptide having at least 95% sequence identity with the amino acid sequence of SEQ ID NO: 2 and conferring an increase in the amount of fine chemical in the organism or the part thereof.

5. The process of claim 1, wherein the organism is a plant.

6. A process for the production of fine chemical comprising increasing or generating expression of at least one nucleic acid molecule in a plant or a part thereof, wherein the at least one nucleic acid molecule is selected from the group consisting of:
   a) a nucleic acid molecule encoding the polypeptide as depicted in SEQ ID NO: 2;
   b) a nucleic acid molecule comprising the nucleotide sequence as depicted in SEQ ID NO: 1; and
   c) a nucleic acid molecule which encodes a polypeptide having at least 95% sequence identity with the amino acid sequence of the polypeptide encoded by the nucleic acid molecule of (a) to (b) and conferring an increase in the amount of fine chemical in an organism or a part thereof;

by introducing the at least one nucleic acid molecule into a plant or a part thereof, and growing the plant or the part thereof under conditions which permit production of at least one fine chemical in said plant or said part thereof, wherein the at least one fine chemical is selected from the group consisting of essential amino acids, non-essential amino acids, modified amino acids, carbohydrates, vitamins, organic acids, fatty acids, and carotenoids.

7. The process of claim 6, wherein the activity of said polypeptide or the expression of said at least one nucleic acid molecule is increased or generated transiently or stably.

8. The process of claim 1, wherein the at least one nucleic acid molecule encodes the polypeptide as depicted in SEQ ID NO: 2 or comprises the nucleotide sequence as depicted in SEQ ID NO: 1.

9. The process of claim 6, wherein the at least one fine chemical is an essential amino acid, a non-essential amino acid, or a modified amino acid.

10. The process of claim 6, wherein the at least one nucleic acid molecule encodes a polypeptide having at least 95% sequence identity with the amino acid sequence of SEQ ID NO: 2 and conferring an increase in the amount of fine chemical in the organism or the part thereof.

11. The process of claim 6, wherein the at least one nucleic acid molecule encodes the polypeptide as depicted in SEQ ID NO: 2 or comprises the nucleotide sequence as depicted in SEQ ID NO: 1.

* * * * *